United States Patent
Hilbert et al.

(10) Patent No.: US 11,318,165 B2
(45) Date of Patent: May 3, 2022

(54) D-DOMAIN CONTAINING POLYPEPTIDES AND USES THEREOF

(71) Applicant: ARCELLX, INC., Gaithersburg, MD (US)

(72) Inventors: David M. Hilbert, Gaithersburg, MD (US); Jeffrey S. Swers, Gaithersburg, MD (US)

(73) Assignee: ARCELLX, INC., Germantown, MD (US)

(*) Notice: Subject to any disclaimer, the term of this patent is extended or adjusted under 35 U.S.C. 154(b) by 0 days.

(21) Appl. No.: 17/471,271

(22) Filed: Sep. 10, 2021

(65) Prior Publication Data

US 2021/0403517 A1    Dec. 30, 2021

Related U.S. Application Data

(63) Continuation of application No. 16/763,784, filed as application No. PCT/US2018/060887 on Nov. 14, 2018.

(60) Provisional application No. 62/585,780, filed on Nov. 14, 2017.

(51) Int. Cl.
| | |
|---|---|
| A61K 35/17 | (2015.01) |
| C07K 14/725 | (2006.01) |
| C07K 14/705 | (2006.01) |
| C07K 14/715 | (2006.01) |
| A61K 47/64 | (2017.01) |
| A61P 35/00 | (2006.01) |
| C07K 14/47 | (2006.01) |
| A61K 38/00 | (2006.01) |
| C07K 16/28 | (2006.01) |
| C12N 15/86 | (2006.01) |
| A61K 39/00 | (2006.01) |

(52) U.S. Cl.
CPC .............. *A61K 35/17* (2013.01); *A61K 47/64* (2017.08); *A61P 35/00* (2018.01); *C07K 14/47* (2013.01); *C07K 14/7051* (2013.01); *C07K 14/70517* (2013.01); *C07K 14/70521* (2013.01); *C07K 14/70578* (2013.01); *C07K 14/7155* (2013.01); *C07K 16/2866* (2013.01); *C12N 15/86* (2013.01); *A61K 38/00* (2013.01); *A61K 2039/505* (2013.01); *A61K 2039/5156* (2013.01); *A61K 2039/5158* (2013.01); *C07K 2317/31* (2013.01); *C07K 2317/622* (2013.01); *C07K 2317/76* (2013.01); *C07K 2319/02* (2013.01); *C07K 2319/03* (2013.01); *C07K 2319/21* (2013.01); *C07K 2319/30* (2013.01); *C07K 2319/31* (2013.01); *C07K 2319/33* (2013.01); *C07K 2319/43* (2013.01); *C12N 2740/15043* (2013.01)

(58) Field of Classification Search
CPC ........ A61K 38/00; A61K 38/16; A61K 38/17; A61K 39/00; A61K 39/0011; A61K 39/001119; C07K 14/00; C07K 14/435
See application file for complete search history.

(56) References Cited

U.S. PATENT DOCUMENTS

| | | |
|---|---|---|
| 6,534,628 B1 | 3/2003 | Nilsson et al. |
| 7,314,974 B2 | 1/2008 | Cao et al. |
| 8,268,756 B2 | 9/2012 | Logtenberg et al. |
| 9,045,545 B1 | 6/2015 | Clube |
| 9,902,758 B2 | 2/2018 | Shin et al. |
| 10,647,775 B2 | 5/2020 | Lafleur et al. |
| 10,662,248 B2 | 5/2020 | Lafleur et al. |
| 11,008,397 B2 | 5/2021 | Lafleur et al. |
| 2012/0195882 A1 | 8/2012 | Doms et al. |
| 2013/0158232 A1 | 6/2013 | Timmerman et al. |
| 2013/0190221 A1 | 7/2013 | Burrows et al. |
| 2016/0311878 A1 | 10/2016 | Shin et al. |
| 2018/0209983 A1 | 7/2018 | Lafleur et al. |
| 2018/0251521 A1 | 9/2018 | Lafleur et al. |
| 2018/0251563 A1 | 9/2018 | Lafleur et al. |
| 2020/0223934 A1 | 7/2020 | Lafleur et al. |
| 2020/0362046 A1 | 11/2020 | Lafleur et al. |
| 2021/0002381 A1 | 1/2021 | Lafleur et al. |

FOREIGN PATENT DOCUMENTS

| | | |
|---|---|---|
| WO | WO 2007019376 | 2/2007 |
| WO | WO 2010124829 | 11/2010 |
| WO | WO 2014138805 | 9/2014 |
| WO | WO 20160154621 | 9/2016 |
| WO | WO 2016164305 | 10/2016 |
| WO | WO 2016164308 | 10/2016 |
| WO | WO 2016164369 | 10/2016 |
| WO | WO2019099433 | 5/2019 |

(Continued)

OTHER PUBLICATIONS

Ali et al., Blood 128(13):1688-1700 (Year: 2016).*

(Continued)

*Primary Examiner* — Jessica H Roark
(74) *Attorney, Agent, or Firm* — Nixon & Vanderhye P.C.

(57) ABSTRACT

D domain (DD) containing polypeptides (DDpp) that specifically bind targets of interest (e.g., BCMA, CD123, CS1, HER2, AFP, and AFP p26) are provided, as are nucleic acids encoding the DDpp, vectors containing the nucleic acids and host cells containing the nucleic acids and vectors. DDpp such as DDpp fusion proteins, are also provided as are methods of making and using the DDpp. Such uses include, but are not limited to diagnostic and therapeutic applications.

38 Claims, 10 Drawing Sheets

Specification includes a Sequence Listing.

(56) References Cited

FOREIGN PATENT DOCUMENTS

WO     WO 2019099440     5/2019

OTHER PUBLICATIONS

Unpublished U.S. Appl. No. 16/763,784, inventor: Hilbert et al., filed May 13, 2020.
Unpublished U.S. Appl. No. 16/763,776, inventor: Hilbert et al., filed May 13, 2020.
Unpublished U.S. Appl. No. 17/228,817, inventor: Lafleur et al., filed Apr. 13, 2021.
International Search Report for PCT/US2016/026054, filed on Apr. 5, 2016; dated Sep. 21, 2016.
Written Opinion of the International Searching Authority for PCT/US2016/026054, filed on Apr. 5, 2016; dated Sep. 21, 2016.
International Search Report for PCT/US2016/025880, filed on Apr. 4, 2016; dated Jul. 26, 2016.
Written Opinion of the International Searching Authority for PCT/US2016/025880, filed on Apr. 4, 2016; dated Jul. 26, 2016.
International Search Report for PCT/US2016/025868, filed on Apr. 4, 2016; dated Sep. 2, 2016.
Written Opinion of the International Searching Authority for PCT/US2016/025868, filed on Apr. 4, 2016; dated Sep. 2, 2016.
International Search Report and Written Opinion of the International Searching Authority for PCT/US2018/060902, filed on Nov. 14, 2018; dated Mar. 27, 2019.
International Search Report and Written Opinion of the International Searching Authority for PCT/US2018/060887, filed on Nov. 14, 2018; dated Apr. 1, 2019.
Walsh et al. "Solution structure and dynamics of a de novo designed three-helix bundle protein," Proceedings of the National Academy of Sciences, vol. 96, No. 10, pp. 5480-5491, May 11, 1999.
Unknown; Lipoprotein, UniProtKB database accession No. F2UEQ6, accessed at https://www.uniprot.org/uniprot/F2UEQ6 on May 20, 2019.
Unknown; Cytoplasmic dynein 2 heavy chain 1, UniProtKB database accession No. Q9SMH5, secondary accession No. Q9ZSS7, accessed at https://www.uniprot.org/uniprot/Q9SMH5 on May 20, 2019.
Unknown; Coiled-coil domain-containing protein 70, UniProtKB database accession No. T2MC19 , accessed at https://www.uniprot.org/uniprot/T2MC19 on May 20, 2019.
Unknown; Protein-disulfide isomerase, UniProtKB database accession No. S9SHI3, accessed at https://www.uniprot.org/uniprot/S9SHI3 on May 20, 2019.
Lafleur et al., "Monoclonal antibody therapeutics with up to five specificities: Functional enhancement through fusion of target-specific peptides" MABS vol. 5. No. 2 pp. 208-218, Mar. 1, 2013.
Per-Ake Nygren "Alternative binding proteins: Affibody binding proteins developed from a small three-helix bundle scaffold : Affibody binding proteins" FEBS Journal vol. 275. No. 11 pp. 2668-2676, Apr. 24, 2008.
Andreas Pluckthun "Designed Ankyrin Repeat Proteins (DARPins): Binding Proteins for Research. Diagnostics. And Therapy" Annual Review of Pharmacology and Toxicology vol. 55 No. 1 pp. 489-511, Jan. 6, 2015.
Walker et al., "Targeting high-risk pediatric solid tumors with CART cells directed against ALK (anaplastic lymphoma kinase, CD246);" J Immunother. Cancer, 2(Suppl 3):P40 (2014).
Mardiros et al. "T cells expressing CD123-specific chimeric antigen receptors exhibit specific cytolytic effector functions and antitumor effects against human acute myeloid leukemia" Blood 122(18). 3138-48 (2013).
Noad et al., "Virus-like particles as immunogens" Trends in Microbiology vol. 11. No. 9 pp. 438-444, Sep. 1, 2003.
Attwood, "The babel of bioinformatics," Science 290(5491):471-473 (2000).
Baker et al., "Protein Structure Prediction and Structural Genomics," Science, 294: 93-96 (2001).
Pakula et al., "Genetic analysis of protein stability and function," Annu. Rev. Genet., 23: 289-310 (1989).
Gilbreth et al., "Structural insights for engineering binding proteins based on non-antibody scaffolds, Current opinion in structural biology," 22:413-420 (2012).
Ngo et al., "Computational Complexity, Protein Structure Prediction, and the Levinthal Paradox," The Protein Folding Problem and Tertiary Structure Prediction, pp. 433 and 492-495 (1994).
Burgess et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," J. of Cell Bio., 111:2129-2138 (1990).
Lazar et al., "Transforming Growth Factor x; Mutation of Aspartic Acid 47 and Leucine 48 Results in Different Biological Activities," Molecular and Cellular Biology, 8(3):1247-1252 (1988).
Bowie et al., "Deciphering the Message in Protein Sequences: Tolerance to Amino Acid Substitutions," Science, 247:1306-1310 (1990).
Traxlmayr, et al., "Directed evolution of proteins for increased stability and expression using yeast display," Archives of Biochemistry Biophysics, 526:74-180 (2012).
Park et al., "Limitations of yeast surface display in engineering proteins of high thermostability," Protein Engineering, Design & Selection, 19(5:211-217 (2006).
Cangelosi et al., "A de novodesigned metalloenzyme for the hydration of $CO_2$," Angew Chem. Int. Ed Engl., 53(30)7900-7903 (2014).
Chakraborty et al., "Realization of a Designed Three-Helix Bundle Capable of Binding Heavy Metals in a Tris (Cysteine) Environment," Angew Chem. Int. Ed Engl., 50(9):2049-2053 (2011).
Mouratou et al., "Artificial Affinity Proteins as Ligands of Immunoglobulins," Biomolecules, 5:60-75 (2015).
Löfblom et al., "Affibody molecules: Engineered proteins for therapeutic, diagnostic and biotechnological applications," FEBS Letters; 584:2670-2680 (2010).
Ronnmark et al., "Human Immunoglobulin A (IgA)-specific ligands from combinatorial engineering of protein A," Eur. J. Biochem., 269:2647-2655 (2002).
Kuchar et al., "Human interleukin-23 receptor antagonists derived from an albumin-binding domain scaffold inhibit IL-23-dependent ex vivo expansion of IL-17-producing T-cells," 82:975-989 (2013).
Heiko et al., "Short term culture of breast tissues to study the activity of the anticancer drug taxol in an intact tumor environment," BMC Cancer 2006, 6: 86, pp. 1-11 (Year:2006).
Hey et al., "Artificial, non-antibody binding proteins for pharmaceutical and industrial applications." Trends Biotechnol. 23(10): 514-522 (2005).

\* cited by examiner

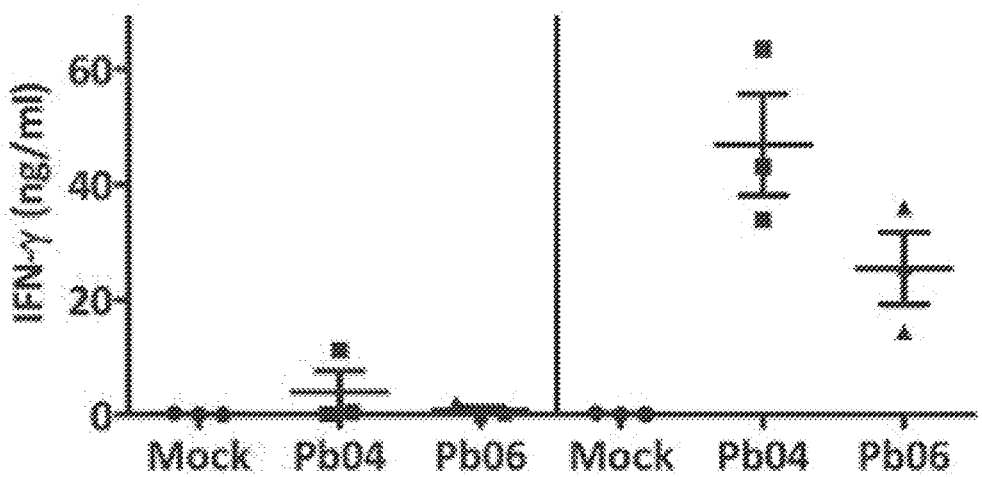
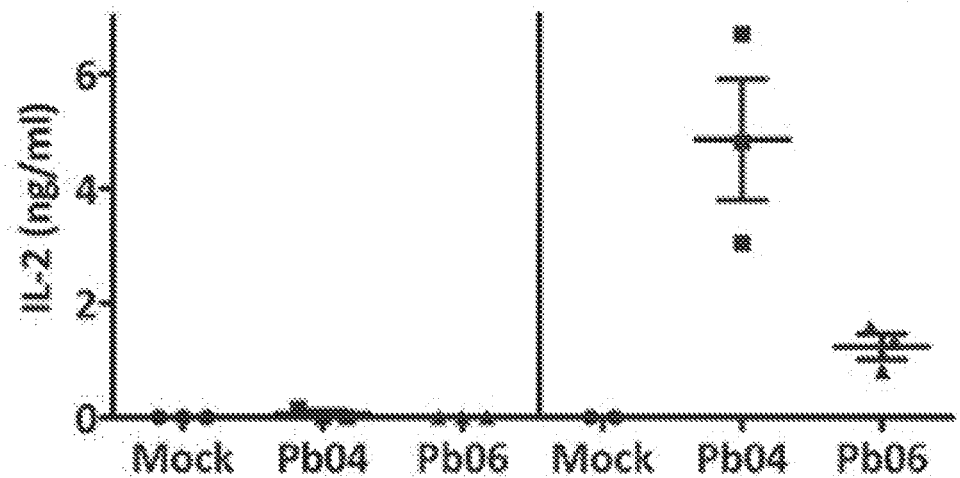

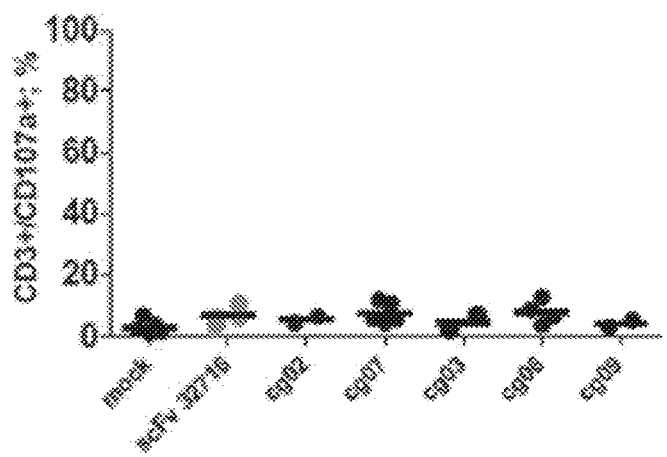
FIG. 4A  T Cells Only
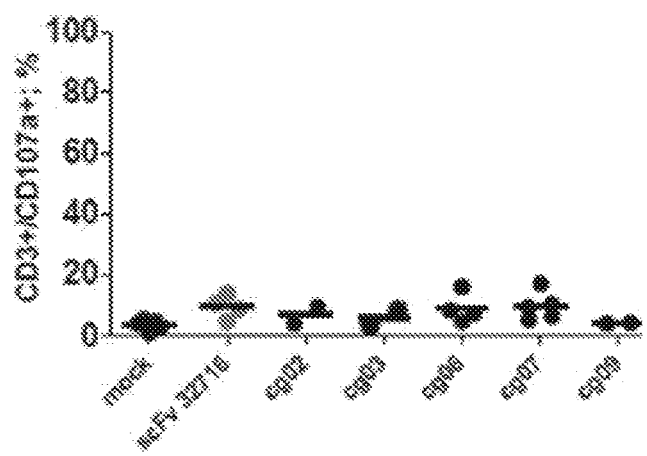
FIG. 4B  T Cells + CD123⁻ K562
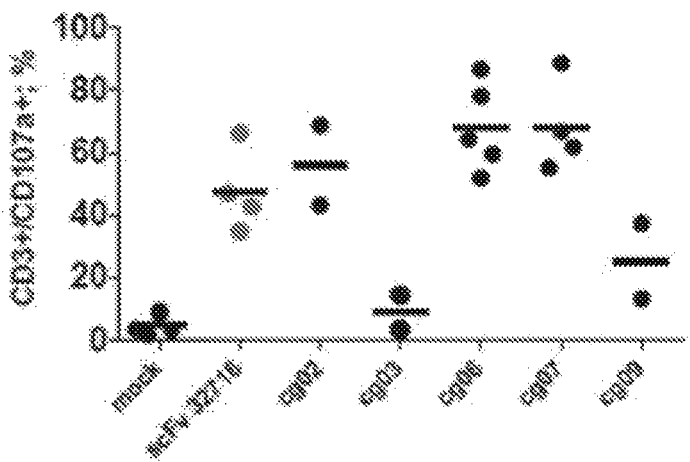
FIG. 4C  T Cells + CD123+ BDCM

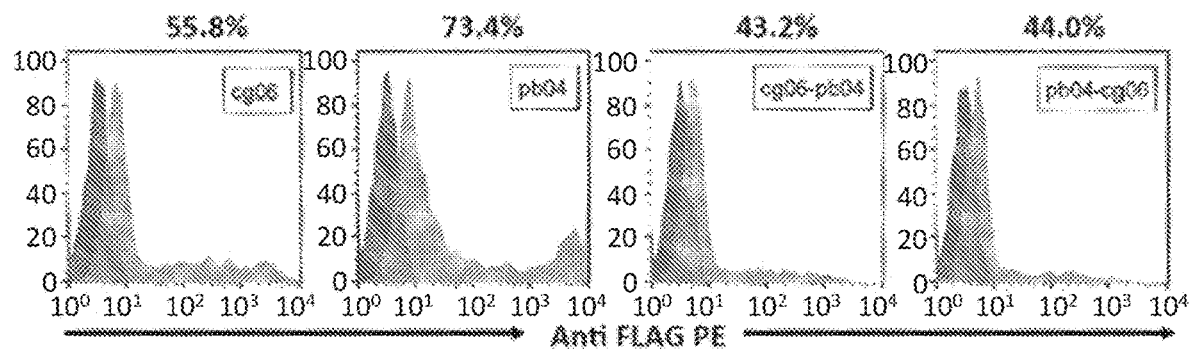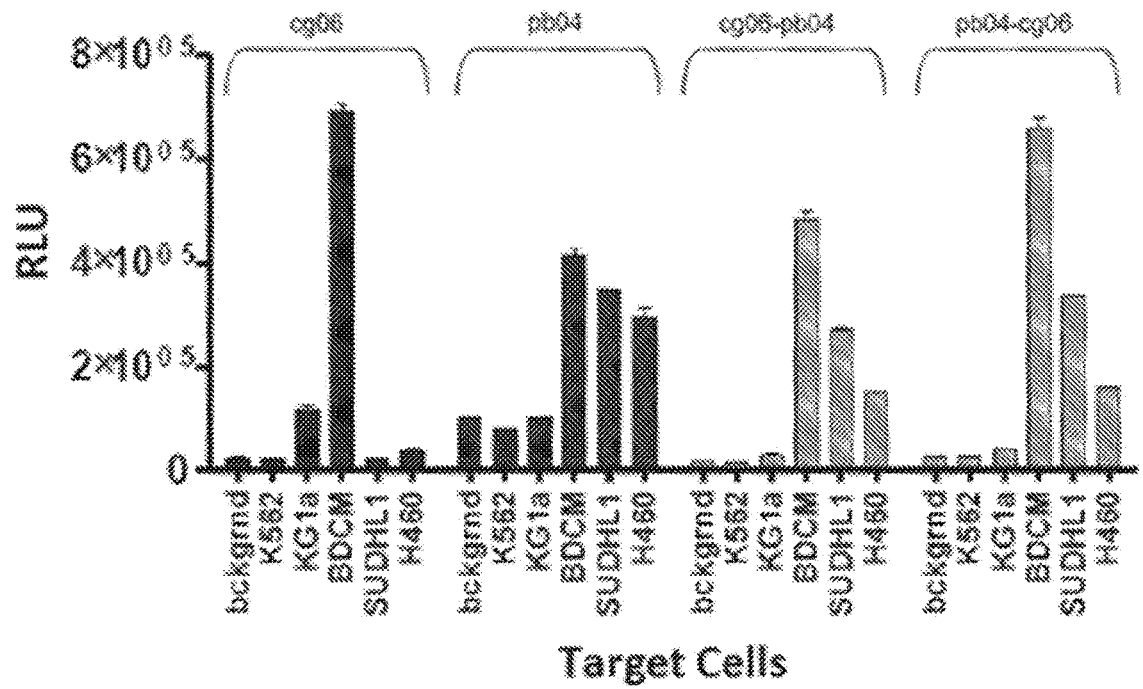

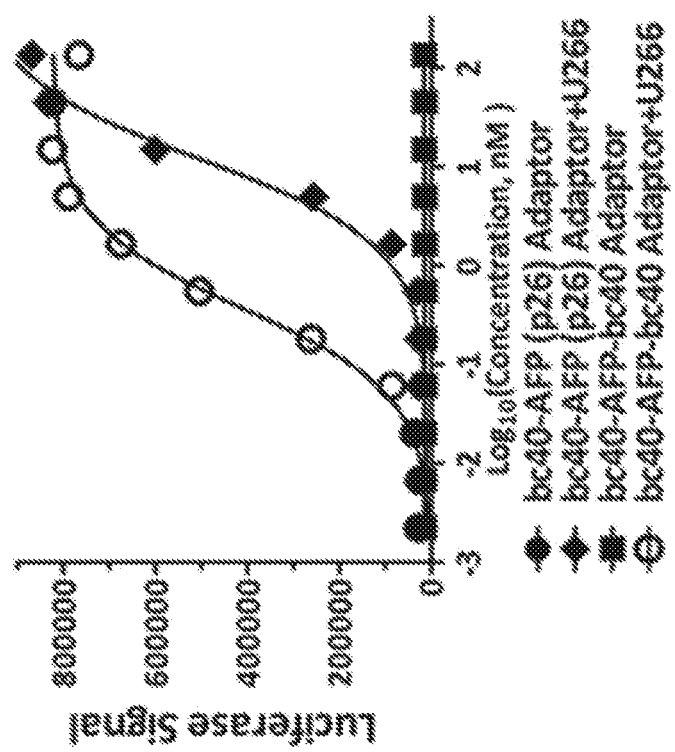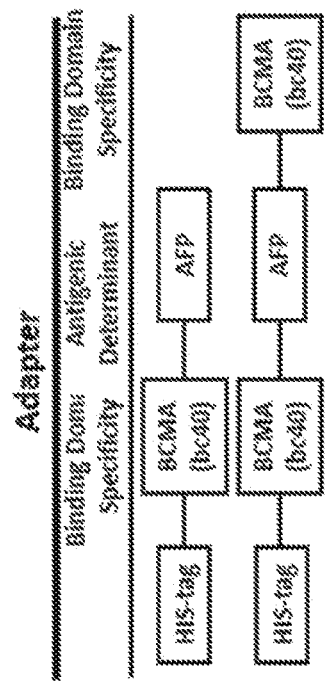
FIG. 7A
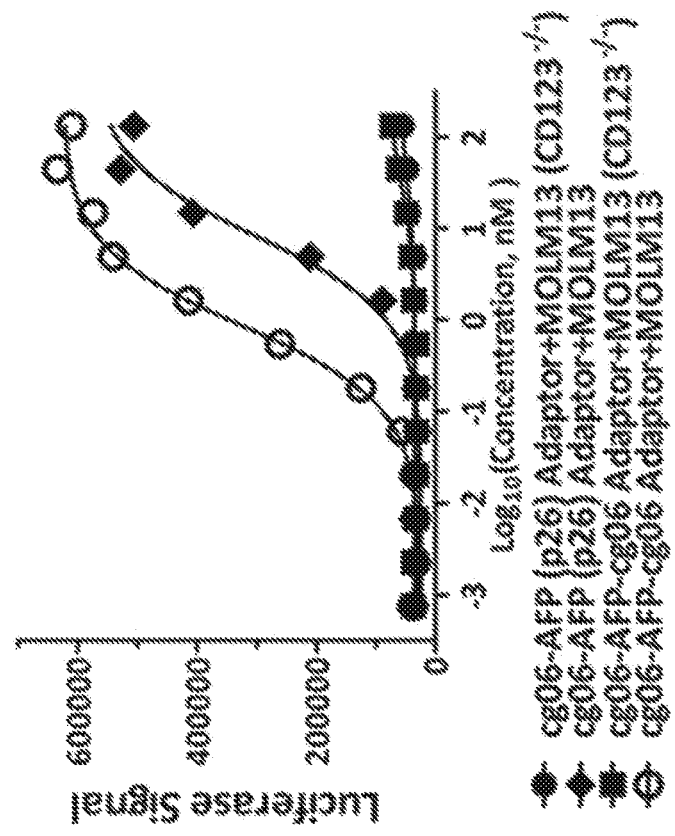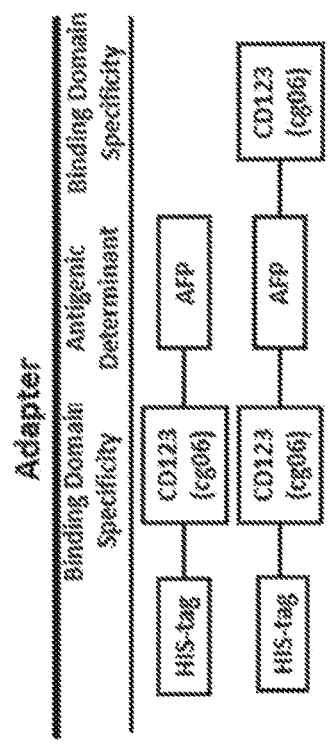
FIG. 7B

D-DOMAIN CONTAINING POLYPEPTIDES AND USES THEREOF

CROSS-REFERENCE TO RELATED APPLICATIONS

This application is a continuation of U.S. application Ser. No. 16/763,784, 371(c) date May 13, 2020, which is a U.S. National Phase of PCT Application No. PCT/US2018/060887, filed Nov. 14, 2018, which claims the benefit of U.S. Provisional Patent Application No. 62/585,780, filed Nov. 14, 2017, each of which is incorporated herein by reference in its entirety.

REFERENCE TO SEQUENCE LISTING SUBMITTED ELECTRONICALLY

The content of the electronically submitted sequence listing (Name: 6666_0211_Sequence_Listing-_ST25.txt; Size: 775,173 bytes; and Date of Creation: Sep. 8, 2021) filed with the application is incorporated herein by reference in its entirety.

BACKGROUND

Antibody-based reagents have accelerated the pace of biological research and development. Antibody compositions represent one of the most important and successful classes of therapeutic and diagnostic agents utilized in the pharmaceutical industry. However, cost, time and efficacy have motivated the development of alternative affinity reagents.

A variety of non-antibody binding formats have emerged for applications historically served by antibodies. While many successes have been reported for unstructured, linear peptides, more robust results have been achieved by imposing a structural constraint on the peptide sequence—typically through the introduction of a disulfide bond. This constraint affords higher affinity and greater specificity through the more favorable thermodynamics of fixed-shape complementarity and surface presentations of residues (e.g., hydrophobic amino acids) that might otherwise be buried and therefore not target-facing (Ladner, Trends in Biotech. 13(10): 426-430 (1995)). Conversely, formats that contain disulfide bonds are typically prone to improper pairing of cysteines, either intra-domain or inter-domain, that can lead to lower expression, product yield and product quality.

Structure found in protein subdomains has provided another source of structural constraint. Structures such as fibronectin type III repeats (adnectins), z-proteins (affibodies), knottins, lipocalins (anticalins) and ankyrin repeats (DARPins) have been developed with antibody-like affinities against a variety of different targets (Hey et al., Trends in Biotech. 23(10): 514-422 (2005)). These domains typically contain two features that are analogous to the frameworks and complementarity determining regions (CDRs) found in antibody variable domains: a structural scaffold that imparts high thermodynamic stability and residues or loops that form the basis of the display library's variability.

SUMMARY

There remains a substantial unmet need for new target-binding compositions, and particularly for such agents containing alternative binding scaffolds (e.g., non-antibody scaffolds). Agents of particular interest may be characterized by, for example, substantially reduced production costs and/or comparable or superior reagent, diagnostic and/or therapeutic properties as compared to antibodies. The present disclosure provides novel target-binding D domain (DD) polypeptides that are based on a non-antibody structural scaffold. In some embodiments, the D domain polypeptides (DDpps) are characterized by high target binding affinity and by a non-antibody structural scaffold. In some embodiments, the DDpps are target-specific binding polypeptides that can advantageously be used to target therapeutics (e.g., immune cells) to particular cells (e.g., diseased cells), thereby reducing or eliminating off-target effects. In some embodiments, the provided DDpps are used as therapeutics to bind cells or soluble factors involved in disease.

In some embodiments, the disclosure provides a protein comprising a D Domain (DD) target binding domain (DDpp) wherein the DD specifically binds a target of interest selected from the group consisting of BCMA (SEQ ID NO: 7), CD123 (SEQ ID NO: 8), CS1 (SEQ ID NO: 965), HER2 (SEQ ID NO: 967), AFP (SEQ ID NO: 9), AFP p26 (SEQ ID NO: 10), or a fragment thereof. In some embodiments, the DDpp are monovalent or multivalent. In some embodiments, the DDpp are monospecific or multispecific. In further embodiments, the monospecific and multivalent. In other embodiments, the DDpp are multispecific and multivalent. Fusion proteins comprising one or more DD are also provided, as are methods of making and using the fusion proteins. Nucleic acids encoding the DDpps and vectors and host cells containing the nucleic acids are also provided. Non-limiting examples of such uses include, but are not limited to target analysis, and diagnostic and therapeutic applications.

In additional embodiments, the disclosure provides a protein comprising a D Domain (DD) target binding domain (DDpp) wherein the DD is a member selected from the group consisting of: (a) a DD that specifically binds BCMA (SEQ ID NO: 7) and comprises the amino acid sequence of SEQ ID NO: 11-305, or 306; (h) a DD that specifically binds CD123 (SEQ ID NO: 8) and comprises the amino acid sequence of SEQ ID NO: 307-739, or 740; (c) a DD that specifically binds AFP (SEQ ID NO: 9) or a fragment thereof, and comprises the amino acid sequence of SEQ ID NO: 741-874, or 886-895; (d) a DD that specifically binds AFP p26 (SEQ ID NO: 10) and comprises the amino acid sequence of SEQ ID NO: 741-874, or 886-895. (e) a DD that specifically binds CS1 (SEQ ID NO: 965) or a fragment thereof, and comprises the amino acid sequence of SEQ ID NO: 896-909, or 910, and (f) a DD that specifically binds HER2 or a fragment thereof, and comprises the amino acid sequence of SEQ ID NO: 911-949, or 950. Proteins comprising variants of (a)-(f) that retain the ability to specifically bind their respective targets are also provided. In some embodiments, the DDpp is fused to a heterologous polypeptide. In some embodiments, the heterologous polypeptide comprises a full-length antibody or an antibody fragment. In some embodiments, the DD is fused to: the amino terminus of a full-length antibody heavy chain; the amino terminus of a full-length antibody light chain; the carboxyl terminus of a full-length antibody heavy chain; or the carboxyl terminus of a full-length antibody light chain. In other embodiments, the DD is fused to an antibody fragment which is an Fc. In additional embodiments, the heterologous polypeptide comprises a member selected from the group consisting of: (i) a transmembrane domain; (ii) a membrane associating domain; (iii) human serum albumin or a fragment thereof; (iv) AFP or a fragment thereof; (v) AFP p26 or a fragment thereof; (vi) the extracellular domain of a receptor or a fragment thereof; and (vii) the extracellular domain of an intracellular receptor (e.g., a nuclear protein) or a fragment thereof. In some embodiments, the protein contains a heterologous polypeptide that comprises the extracellular domain, or a fragment of an extracellular domain of BCMA (SEQ ID NO: 7) or CD123 (SEQ ID NO: 8) or CD19 (SEQ ID NO: 3) or CS1 (SEQ ID NO: 965). In some embodiments, the protein contains a heterologous polypeptide that comprises the extracellular domain, or a fragment of an extracellular domain, of a receptor selected from the group consisting of: CD19, CD20, CD22, HVEM, BTLA, DR3, CD37; TSLPR, IL7R, and gp96. In some embodiments, the protein contains a heterologous polypeptide that comprises an antigenic portion of a serum protein (e.g., AFP, and AFP p26). In some embodiments, the protein contains a heterologous polypeptide that comprises an antigenic portion of an intracellular protein (e.g., a nuclear protein). In some embodiments, the protein is labeled. In further embodiments, the label is selected from the group consisting of an enzymatic label, a fluorescent label, a luminescent label, a bioluminescent label, and a biotin moiety. In additional embodiments, the protein is conjugated to a therapeutic or cytotoxic agent. In some embodiments, the protein contains a heterologous polypeptide that binds to one or more with major histocompatibility complex (MHC) class I or class II complexes.

In some embodiments, a DD of the DDpp specifically binds BCMA. In some embodiments, the DD specifically binds a BCMA protein having an amino acid sequence consisting of SEQ ID NO: 7. In further embodiments, the DDpp comprises an amino acid sequence selected from the group consisting of SEQ ID NO: 11-305, and 306. In other embodiments, the BCMA-binding DDpp comprises a variant of an amino acid sequence selected from the group consisting of SEQ ID NO: 11-305, and 306. In some embodiments, the DDpp comprises multiple target-binding domains (e.g., dimers, trimers, etc.). In some embodiments, the DDpp comprises 2, 3, 4, 5, or more than 5, DD that bind BCMA. In some embodiments, the DDpp comprises 2, 3, 4, 5, or more than 5, DD that have the same sequence. In some embodiments, the DDpp comprises 2, 3, 4, 5 or more than 5, DD that bind to different epitopes of BCMA. In some embodiments, the DDpp comprises a DD that specifically binds BCMA and further comprises 2, 3, 4, 5 or more than 5, additional different DDs or target-binding binding domains (e.g., scFvs) that bind to BCMA or a different target antigen. In some embodiments, the DDpp comprises a DD that specifically binds BCMA and further comprises one or more additional DDs or other target-binding binding domains that bind one or more antigens expressed on the surface of a B cell. In some embodiments, the DDpp comprises a DD that specifically binds BCMA and further comprises one or more additional DDs or other target-binding binding domains that bind one or more cancer antigens. In some embodiments, the DDpp specifically binds 2, 3, 4, 5, or more than 5, different targets. In further embodiments, the DDpp specifically binds 2, 3, 4, 5, or more than 5, different cancer antigens. In some embodiments, the DDpp specifically binds 2, 3, 4, 5, or more than 5, different cancer antigens expressed on the surface of a cancer cell. In some embodiments, the DDpp specifically binds 2, 3, 4, 5, or more than 5, cancer antigens expressed on the surface of different cancer cells.

In some embodiments, the DDpp is a fusion protein comprising a DD that specifically binds BCMA. In some embodiments, the DDpp fusion protein comprises a DD that specifically binds a BCMA protein having an amino acid sequence consisting of SEQ ID NO: 7. In some embodiments, the DDpp is a fusion protein comprising a DD that comprises an amino acid sequence selected from the group consisting of SEQ ID NO: 11-305, and 306. In other embodiments, the BCMA-binding DDpp fusion protein comprises a variant of an amino acid sequence selected from the group consisting of SEQ ID NO: 11-305, and 306. In some embodiments, the DDpp fusion protein comprises a full-length antibody or a portion (fragment) of an antibody. In some embodiment, the DDpp fusion protein comprises a full length IgG antibody (e.g., IgG1, IgG2, IgG2, or IgG4). In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the BCMA-binding DDpp is an Fc fusion protein.

In some embodiments, the DDpp fusion protein comprises a BCMA-binding DD operably linked to a serum protein. In some embodiments, the DDpp fusion protein comprises an amino acid sequence selected from the group consisting of SEQ ID NO: 11-305, and 306. In other embodiments, the BCMA-binding DDpp fusion protein comprises a variant of an amino acid sequence selected from the group consisting of SEQ ID NO: 11-305, and 306. In further embodiments, the DDpp fusion protein comprises human serum albumin or a fragment thereof. In some embodiments, the DDpp fusion protein comprises AFP or AFP p26, or a fragment thereof. In some embodiments, the DDpp fusion protein comprises AFP (e.g., SEQ ID NO: 9), or a fragment thereof. In other embodiments, the DDpp fusion protein comprises AFP p26 (SEQ ID NO: 10), or a fragment thereof.

In some embodiments, the DDpp fusion protein is a soluble protein comprising one or more target-binding DDpp and a p29 protein (e.g., having the sequence of SEQ ID NO: 10, 968, 969, 970, 971, 972, 973, or 974). Such fusion proteins containing p29 sequences have been discovered herein to have surprisingly long serum half-life. In some embodiments, the soluble DDpp fusion protein has a plasma half-life in vivo of at least 1 hour, at least 2 hours, at least 4 hours, at least 8 hours, at least 16 hours, at least 32 hours, at least 64 hours, or more. In some embodiments, the soluble fusion protein has an in vivo plasma half-life of at least 1 hour, at least 2 hours, at least 4 hours, at least 8 hours, at least 16 hours, at least 32 hours, at least 64 hours, or more hours 65 hours, or 1-10 hours, 2-10 hours, 4-10 hours, 6-10 hours, or 6-9 hours in a mouse. In some embodiments, the soluble DDpp fusion protein has an in vivo plasma half-life of at least 1 hour, at least 2 hours, at least 4 hours, at least 8 hours, at least 16 hours, at least 32 hours, at least 64 hours, or more hours 65 hours, or 1-10 hours, 2-10 hours, 4-10 hours, 6-10 hours, or 6-9 hours, in a human.

In some embodiments, the BCMA-binding DDpp fusion protein comprises the extracellular domain of a receptor or a fragment thereof. In some embodiments, the DDpp fusion protein comprises a DD that comprises an amino acid sequence selected from the group consisting of SEQ ID NO: 11-305, and 306. In other embodiments, the BCMA-binding DDpp fusion protein comprises a variant of an amino acid sequence selected from the group consisting of SEQ ID NO: 11-305, and 306. In further embodiments, the CD123-binding DDpp fusion protein comprises the extracellular domain of CD123 (SEQ ID NO: 8), or a fragment thereof. In some embodiments, the BCMA-binding DDpp fusion protein comprises the extracellular domain of a receptor selected from the group consisting of: CD19, CD20, CD22, HVEM, BTLA, DR3, CD37, CS1, TSLPR, IL7R, and gp96, or a fragment thereof.

In additional embodiments, the BCMA-binding DDpp fusion protein comprises an intracellular protein (e.g., a nuclear protein) or a fragment thereof. In some embodiments, the DDpp fusion protein comprises a DD that comprises an amino acid sequence selected from the group consisting of SEQ ID NO: 11-305, and 306. In other embodiments, the BCMA-binding DDpp fusion protein comprises a variant of an amino acid sequence selected from the group consisting of SEQ ID NO: 11-305, and 306. In some embodiments, the BCMA-binding DDpp fusion protein comprises a fragment of a serum protein (e.g., HSA, AFP, and AFP p26), an extracellular domain of a receptor (e.g. BCMA, CD123, CS1, and CD19), or an intracellular protein (e.g., a nuclear protein), consisting of 5-500, 5-400, 5-300, 5-200, 5-100, 5-50, 10-500, 10-400, 10-300, 10-200, 10-100, or 10-50 amino acid residues.

In some embodiments, a DD of the DDpp specifically binds CD123. In some embodiments, the DDpp specifically binds a CD123 protein having an amino acid sequence consisting of SEQ ID NO: 8. In further embodiments, the DDpp comprises an amino acid sequence selected from the group consisting of SEQ ID NO: 307-739, and 740. In other embodiments, the CD123-binding DDpp comprises a variant of an amino acid sequence selected from the group consisting of SEQ ID NO: 307-739, and 740. In some embodiments, the DDpp comprises multiple target-binding domains (e.g., dimers, trimers, etc.). In some embodiments, the DDpp comprises 2, 3, 4, 5, or more than 5, DD, that bind CD123. In some embodiments, the DDpp comprises 2, 3, 4, 5, or more than 5, DD, that have the same sequence. In some embodiments, the DDpp comprises 2, 3, 4, 5 or more than 5, DD that bind to different epitopes of CD123. In some embodiments, the DDpp comprises a DD that specifically binds CD123 and further comprises 2, 3, 4, 5 or more than 5, additional different DDs or target-binding binding domains (e.g., scFvs) that bind to BCMA or a different target antigen. In some embodiments, the DDpp comprises a DD that specifically binds CD123 and further comprises one or more additional DDs or other target-binding binding domains that bind one or more antigens expressed on the surface of a B cell. In some embodiments, the DDpp comprises a DD that specifically binds CD123 and further comprises one or more additional DDs or other target-binding binding domains that bind one or more cancer antigens. In some embodiments, the DDpp specifically binds 2, 3, 4, 5, or more than 5, different targets. In further embodiments, the DDpp specifically binds 2, 3, 4, 5, or more than 5, different cancer antigens. In some embodiments, the DDpp specifically binds 2, 3, 4, 5, or more than 5, different cancer antigens expressed on the surface of a cancer cell. In some embodiments, the DDpp specifically binds 2, 3, 4, 5, or more than 5, cancer antigens expressed on the surface of different cancer cells.

In some embodiments, the DDpp is a fusion protein comprising a DD that specifically binds CD123. In some embodiments, the DD specifically binds a CD123 protein having an amino acid sequence consisting of SEQ ID NO: 8. In some embodiments, the DDpp comprises an amino acid sequence selected from the group consisting of SEQ ID NO: 307-739, and 740. In other embodiments, the CD123-binding DDpp fusion protein comprises a variant of an amino acid sequence selected from the group consisting of SEQ ID NO: 307-739, and 740. In some embodiments, the DDpp fusion protein comprises a full-length antibody or a portion (fragment) of an antibody. In some embodiments, the DDpp fusion protein comprises a full length IgG antibody (e.g., IgG1, IgG2, IgG2, or IgG4). In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN8828. In other embodiments, the CD123-binding DDpp is an Fc fusion protein.

In some embodiments, the DDpp fusion protein comprises a CD123-binding DD operably linked to a serum protein. In some embodiments, the DDpp fusion protein comprises an amino acid sequence selected from the group consisting of SEQ ID NO: 307-739, and 740. In other embodiments, the CD123-binding DDpp fusion protein comprises a variant of an amino acid sequence selected from the group consisting of SEQ ID NO: 307-739, and 740. In further embodiments, the DDpp fusion protein comprises human serum albumin or a fragment thereof. In some embodiments, the DDpp fusion protein comprises AFP or AFP p26, or a fragment thereof. In some embodiments, the DDpp fusion protein comprises AFP (e.g., SEQ ID NO: 9), or a fragment thereof. In other embodiments, the DDpp fusion protein comprises AFP p26 (SEQ ID NO: 10), or a fragment thereof.

In some embodiments, the CD123-binding DDpp fusion protein comprises the extracellular domain of a receptor or a fragment thereof. In some embodiments, the CD123-binding DDpp fusion protein comprises an amino acid sequence selected from the group consisting of SEQ ID NO: 307-739, and 740. In other embodiments, the CD123-binding DDpp fusion protein comprises a variant of an amino acid sequence selected from the group consisting of SEQ ID NO: 307-739, and 740. In further embodiments, the CD123-binding DDpp fusion protein comprises the extracellular domain of BCMA (SEQ ID NO: 7) or CD123 (SEQ ID NO: 8), or a fragment thereof. In further embodiments, the CD123-binding DDpp fusion protein comprises the extracellular domain of BCMA (SEQ ID NO: 7), or CD123 (SEQ ID NO: 8), or CS1 (SEQ ID NO: 965), or a fragment thereof. In some embodiments, the CD123-binding DDpp fusion protein comprises the extracellular domain of a receptor selected from the group consisting of: CD19, CD20, CD22, HVEM, BTLA, DR3, CD37, CS1, TSLPR, IL7R, and gp96, or a fragment thereof.

In additional embodiments, the CD123-binding DDpp fusion protein comprises an intracellular protein (e.g., a nuclear protein) or a fragment thereof. In some embodiments, the CD123-binding DDpp fusion protein comprises an amino acid sequence selected from the group consisting of SEQ ID NO: 307-739, and 740. In other embodiments, the CD123-binding DDpp fusion protein comprises a variant of an amino acid sequence selected from the group consisting of SEQ ID NO: 307-739, and 740.

In some embodiments, the CD123-binding DDpp fusion protein comprises a fragment of a serum protein (e.g., HSA, AFP, and AFP 26), an extracellular domain of a receptor (e.g., BCMA, CS1, CD123, and CD19), or an intracellular protein (e.g., a nuclear protein), consisting of 5-500, 5-400, 5-300, 5-200, 5-100, 5-50, 10-500, 10-400, 10-300, 10-200, 10-100, or 10-50 amino acid residues.

In some embodiments, a DD of the DDpp specifically binds CS1. In some embodiments, the DDpp specifically binds a CS1 protein having an amino acid sequence consisting of SEQ ID NO: 965. In further embodiments, the DDpp comprises an amino acid sequence selected from the group consisting of SEQ ID NO: 896-909, and 910. In other embodiments, the CS1-binding DDpp comprises a variant of an amino acid sequence selected from the group consisting of SEQ ID NO: 896-909, and 910. In some embodiments, the DDpp comprises multiple target-binding domains (e.g., dimers, trimers, etc.). In some embodiments, the DDpp comprises 2, 3, 4, 5, or more than 5, DD, that bind CS1. In some embodiments, the DDpp comprises 2, 3, 4, 5, or more than 5, DD, that have the same sequence. In some embodiments, the DDpp comprises 2, 3, 4, 5 or more than 5, DD that bind to different epitopes of CS1. In some embodiments, the DDpp comprises a DD that specifically binds CS1 and further comprises 2, 3, 4, 5 or more than 5, additional different DDs or target-binding binding domains (e.g., scFvs) that bind to BCMA or a different target antigen. In some embodiments, the DDpp comprises a DD that specifically binds CS1 and further comprises one or more additional DDs or other target-binding binding domains that bind one or more antigens expressed on the surface of a B cell. In some embodiments, the DDpp comprises a DD that specifically binds CS1 and further comprises one or more additional DDs or other target-binding binding domains that bind one or more cancer antigens. In some embodiments, the DDpp specifically binds 2, 3, 4, 5, or more than 5, different targets. In further embodiments, the DDpp specifically binds 2, 3, 4, 5, or more than 5, different cancer antigens. In some embodiments, the DDpp specifically binds 2, 3, 4, 5, or more than 5, different cancer antigens expressed on the surface of a cancer cell. In some embodiments, the DDpp specifically binds 2, 3, 4, 5, or more than 5, cancer antigens expressed on the surface of different cancer cells.

In some embodiments, the DDpp is a fusion protein comprising a DD that specifically binds CS1. In some embodiments, the DD specifically binds a CS1 protein having an amino acid sequence consisting of SEQ ID NO: 965. In some embodiments, the DDpp comprises an amino acid sequence selected from the group consisting of SEQ ID NO: 896-909, and 910. In other embodiments, the CS1-binding DDpp fusion protein comprises a variant of an amino acid sequence selected from the group consisting of SEQ ID NO: 896-909, and 910. In some embodiments, the DDpp fusion protein comprises a full-length antibody or a portion (fragment) of an antibody. In some embodiments, the DDpp fusion protein comprises a full length IgG antibody (e.g., IgG1, IgG2, IgG2, or IgG4). In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN8828. In other embodiments, the CS1-binding DDpp is an Fc fusion protein.

In some embodiments, the DDpp fusion protein comprises a CS1-binding DD operably linked to a serum protein. In some embodiments, the DDpp fusion protein comprises an amino acid sequence selected from the group consisting of SEQ ID NO: 896-909, and 910. In other embodiments, the CS1-binding DDpp fusion protein comprises a variant of an amino acid sequence selected from the group consisting of SEQ ID NO: 896-909, and 910. In further embodiments, the DDpp fusion protein comprises human serum albumin or a fragment thereof. In some embodiments, the DDpp fusion protein comprises AFP or AFP p26, or a fragment thereof. In some embodiments, the DDpp fusion protein comprises AFP (e.g., SEQ ID NO: 9), or a fragment thereof. In other embodiments, the DDpp fusion protein comprises AFP p26 (SEQ ID NO: 10), or a fragment thereof.

In some embodiments, the CS1-binding DDpp fusion protein comprises the extracellular domain of a receptor or a fragment thereof. In some embodiments, the CS1-binding DDpp fusion protein comprises an amino acid sequence selected from the group consisting of SEQ ID NO: 896-909, and 910. In other embodiments, the CS1-binding DDpp fusion protein comprises a variant of an amino acid sequence selected from the group consisting of SEQ ID NO: 896-909, and 910. In further embodiments, the CS1-binding DDpp fusion protein comprises the extracellular domain of BCMA (SEQ ID NO: 7), CD123 (SEQ ID NO: 8), or CS1 (SEQ ID NO: 965), or a fragment thereof. In some embodiments, the CS1-binding DDpp fusion protein comprises the extracellular domain of a receptor selected from the group consisting of: CD19, CD20, CD22, HVEM, BTLA, DR3, CD37, CS-1, TSLPR, IL7R, and gp96, or a fragment thereof.

In additional embodiments, the CS1-binding DDpp fusion protein comprises an intracellular protein (e.g., a nuclear protein) or a fragment thereof. In some embodiments, the CS1-binding DDpp fusion protein comprises an amino acid sequence selected from the group consisting of SEQ ID NO: 896-909, and 910. In other embodiments, the CS1-binding DDpp fusion protein comprises a variant of an amino acid sequence selected from the group consisting of SEQ ID NO: 896-909, and 910.

In some embodiments, the CS1-binding DDpp fusion protein comprises a fragment of a serum protein (e.g., HSA, AFP, and AFP 26), an extracellular domain of a receptor (e.g., BCMA, CS1, CD123, and CD19), or an intracellular protein (e.g., a nuclear protein), consisting of 5-500, 5-400, 5-300, 5-200, 5-100, 5-50, 10-500, 10-400, 10-300, 10-200, 10-100, or 10-50 amino acid residues.

In some embodiments, a DD of the DDpp specifically binds AFP or a fragment thereof. In some embodiments, the DDpp specifically binds an AFP protein having an amino acid sequence consisting of SEQ ID NO: 9 or a fragment thereof. In further embodiments, the DDpp comprises an amino acid sequence selected from the group consisting of SEQ ID NO: 741-874, and 886-895. In other embodiments, the DDpp comprises a variant of an amino acid sequence selected from the group consisting of SEQ ID NO: 741-874, and 886-895. In some embodiments, the DDpp comprises multiple target-binding domains (e.g., dimers, trimers, etc.). In some embodiments, the DDpp comprises 2, 3, 4, 5, or more than 5, DD, that bind AFP or a fragment thereof. In some embodiments, the DDpp comprises 2, 3, 4, 5, or more than 5, DD, that have the same sequence. In some embodiments, the DDpp comprises 2, 3, 4, 5 or more than 5, DD that bind to different epitopes of AFP or a fragment thereof. In some embodiments, the DDpp comprises a DD that specifically binds AFP or a fragment thereof and further comprises 2, 3, 4, 5 or more than 5, additional different DDs or target-binding binding domains (e.g., scFvs) that bind to AFP, an AFP fragment, or a different target antigen. In some embodiments, the DDpp comprises a DD that specifically binds AFP or a fragment thereof and further comprises one or more additional DDs or other target-binding binding domains that bind one or more antigens expressed on the surface of a B cell. In some embodiments, the DDpp comprises a DD that specifically binds AFP and further comprises one or more additional DDs or other target-binding binding domains that bind one or more cancer antigens. In some embodiments, the DDpp specifically binds 2, 3, 4, 5, or more than 5, different targets. In further embodiments, the DDpp specifically binds 2, 3, 4, 5, or more than 5, different cancer antigens. In some embodiments, the DDpp specifically binds 2, 3, 4, 5, or more than 5, different cancer antigens expressed on the surface of a cancer cell. In some embodiments, the DDpp specifically binds 2, 3, 4, 5, or more than 5, cancer antigens expressed on the surface of different cancer cells.

In some embodiments, the DDpp is a fusion protein comprising a DD that specifically binds AFP, or a fragment thereof. In some embodiments, the DD specifically binds an AFP protein having an amino acid sequence consisting of SEQ ID NO: 9, or a fragment thereof. In further embodiments, the DDpp comprises an amino acid sequence selected from the group consisting of SEQ ID NO: 741-874, and 886-895. In other embodiments, the AFP-binding DDpp comprises a variant of an amino acid sequence selected from the group consisting of SEQ ID NO: 741-874, and 886-895. In some embodiments, the fusion protein comprises an AFP-binding DD operably linked to a full-length antibody or a portion (fragment) of an antibody. In some embodiments, the DDpp fusion protein comprises a full length IgG antibody (e.g., IgG1, IgG2, IgG2, or IgG4). In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882. In some embodiments, the AFP-binding DDpp is an Fc fusion protein.

In some embodiments, the DDpp fusion protein comprises a DD that specifically binds AFP or an AFP fragment, operably linked to a serum protein. In some embodiments, the DDpp fusion protein comprises an amino acid sequence selected from the group consisting of SEQ ID NO: 741-874, and 886-895. In other embodiments, the AFP-binding DDpp comprises a variant of an amino acid sequence selected from the group consisting of SEQ ID NO: 741-874, and 886-895. In further embodiments, the DDpp fusion protein comprises human serum albumin or a fragment thereof.

In some embodiments, the DDpp fusion protein comprises a DD that specifically binds AFP or an AFP fragment and further comprises the extracellular domain of a receptor or a fragment thereof. In some embodiments, the DDpp fusion protein comprises an amino acid sequence selected from the group consisting of SEQ ID NO: 741-874, and 886-895. In other embodiments, the AFP-binding DDpp comprises a variant of an amino acid sequence selected from the group consisting of SEQ ID NO: 741-874, and 886-895. In some embodiments, the DDpp fusion protein comprises the extracellular domain of BCMA (SEQ ID NO: 7) or CD123 (SEQ ID NO: 8), or a fragment thereof. In some embodiments, the DDpp fusion protein comprises the extracellular domain of BCMA (SEQ ID NO: 7), or CD123 (SEQ ID NO: 8), or CS1 (SEQ ID NO: 965), or a fragment thereof. In some embodiments, the DDpp fusion protein comprises the extracellular domain of a receptor selected from the group consisting of: CD19, CD20, CD22, HVEM, BTLA, DR3, CD37; TSLPR, IL7R, and gp96, or a fragment thereof.

In additional embodiments, the DDpp fusion protein comprises a DD that specifically binds AFP or an AFP fragment and further comprises an intracellular protein (e.g., a nuclear protein) or a fragment thereof. In some embodiments, the DDpp fusion protein comprises an amino acid sequence selected from the group consisting of SEQ ID NO: 741-874, and 886-895. In other embodiments, the AFP-binding DDpp comprises a variant of an amino acid sequence selected from the group consisting of SEQ ID NO: 741-874, and 886-895.

In some embodiments, the AFP-binding DDpp fusion protein comprises a fragment of a serum protein (e.g., HSA), an extracellular domain of a receptor (e.g., BCMA, CS1, CD123, and CD19), or an intracellular protein (e.g., a nuclear protein), consisting of 5-500, 5-400, 5-300, 5-200, 5-100, 5-50, 10-500, 10-400, 10-300, 10-200, 10-100, or 10-50 amino acid residues.

In some embodiments, a DD of the DDpp specifically binds AFP p26. In some embodiments, the DDpp specifically binds AFP p26 having an amino acid sequence consisting of SEQ ID NO: 10, or a fragment thereof. In some embodiments, the DDpp comprises an amino acid sequence selected from the group consisting of SEQ ID NO: 741-874, and 886-895. In further embodiments, the DDpp comprises a variant of an amino acid sequence selected from the group consisting of SEQ ID NO: 741-874, and 886-895. In further embodiments, the DD specifically binds AFP p26 having an amino acid sequence consisting of SEQ ID NO: 10, but does not specifically bind AFP having an amino acid sequence consisting of SEQ ID NO: 9. In some embodiments, the DDpp comprises multiple target-binding domains (e.g., dimers, trimers, etc.). In some embodiments, the DDpp comprises 2, 3, 4, 5, or more than 5, DD, that bind AFP p26. In some embodiments, the DDpp comprises 2, 3, 4, 5, or more than 5, DD, that have the same sequence. In some embodiments, the DDpp comprises 2, 3, 4, 5 or more than 5, DD that bind to different epitopes of AFP p26. In some embodiments, the DDpp comprises a DD that specifically binds AFP p26 and further comprises 2, 3, 4, 5 or more than 5, additional different DDs or target-binding binding domains (e.g., scFvs) that bind to AFP p26 or a different target antigen. In some embodiments, the DDpp comprises a DD that specifically binds AFP p26 and further comprises one or more additional DDs or other target-binding binding domains that bind one or more antigens expressed on the surface of a B cell. In some embodiments, the DDpp comprises a DD that specifically binds AFP p26 and further comprises one or more additional DDs or other target-binding binding domains that bind one or more cancer antigens. In some embodiments, the DDpp specifically binds 2, 3, 4, 5, or more than 5, different targets. In further embodiments, the DDpp specifically binds 2, 3, 4, 5, or more than 5, different cancer antigens. In some embodiments, the DDpp specifically binds 2, 3, 4, 5, or more than 5, different cancer antigens expressed on the surface of a cancer cell. In some embodiments, the DDpp specifically binds 2, 3, 4, 5, or more than 5, cancer antigens expressed on the surface of different cancer cells.

In some embodiments, the DDpp is a fusion protein comprising a DD that specifically binds AFP p26. In some embodiments, the DD specifically binds AFP p26 having an amino acid sequence consisting of SEQ ID NO: 10. In some embodiments, the DDpp fusion protein comprises an amino acid sequence selected from the group consisting of SEQ ID NO: 741-874, and 886-895. In other embodiments, the AFP p26-binding DDpp fusion protein comprises an amino acid sequence selected from the group consisting of SEQ ID NO: 741-874, and 886-895. In some embodiments, a DD of the DDpp fusion protein specifically binds AFP p26 but does not specifically bind AFP having an amino acid sequence consisting of SEQ ID NO: 9. In further embodiments, the DDpp is a fusion protein comprising an amino acid sequence selected from the group consisting of SEQ ID NO: 741-874, and 886-895. In other embodiments, the DDpp comprises a variant of an amino acid sequence selected from the group consisting of SEQ ID NO: 741-874, and 886-895. In other embodiments, the AFP p26-binding DDpp is an Fc fusion protein.

In some embodiments, the DDpp fusion protein comprises a DD that specifically binds AFP p26. In other embodiments, the DDpp fusion protein comprises an AFP p26-binding DD operably linked to a serum protein. In some embodiments, the DDpp fusion protein comprises an amino acid sequence selected from the group consisting of SEQ ID NO: 741-874, and 886-895. In other embodiments, the AFP p26-binding DDpp fusion protein comprises a variant of an amino acid sequence selected from the group consisting of SEQ ID NO: 741-874, and 886-895. In further embodiments, the DDpp fusion protein comprises human serum albumin or a fragment thereof.

In some embodiments, the DDpp fusion protein comprises an AFP p26-binding DD and further comprises the extracellular domain of a receptor or a fragment thereof. In some embodiments, the DDpp fusion protein comprises an amino acid sequence selected from the group consisting of SEQ ID NO: 741-874, and 886-895. In other embodiments, the AFP p26-binding DDpp fusion protein comprises a variant of an amino acid sequence selected from the group consisting of SEQ ID NO: 741-874, and 886-895. In some embodiments, the DDpp fusion protein comprises the extracellular domain of BCMA (SEQ ID NO: 7) or CD123 (SEQ ID NO: 8), or a fragment thereof. In some embodiments, the DDpp fusion protein comprises the extracellular domain of BCMA (SEQ ID NO: 7), CD123 (SEQ ID NO: 8), or CS1 (SEQ ID NO: 965), or a fragment thereof. In some embodiments, the DDpp fusion protein comprises the extracellular domain of a receptor selected from the group consisting of: CD19, CD20, CD22, HVEM, BTLA, DR3, CD37; TSLPR, IL7R, and gp96, or a fragment thereof.

In additional embodiments, the DDpp fusion protein comprises an AFP p26-binding DD and further comprises an intracellular protein (e.g., a nuclear protein) or a fragment thereof. In some embodiments, the DDpp fusion protein comprises an amino acid sequence selected from the group consisting of SEQ ID NO: 741-874, and 886-895. In other embodiments, the AFP p26-binding DDpp fusion protein comprises a variant of an amino acid sequence selected from the group consisting of SEQ ID NO: 741-874, and 886-895. In some embodiments, the AFP p26-binding DDpp fusion protein comprises a fragment of a serum protein (e.g., HSA), an extracellular domain of a receptor (e.g., BCMA, CS1, CD123, and CD19), or an intracellular protein (e.g., a nuclear protein), consisting of 5-500, 5-400, 5-300, 5-200, 5-100, 5-50, 10-500, 10-400, 10-300, 10-200, 10-100, or 10-50 amino acid residues.

In some embodiments, a DD of the DDpp specifically binds HER2. In some embodiments, the DDpp specifically binds a HER2 protein having an amino acid sequence consisting of SEQ ID NO: 967. In further embodiments, the DDpp comprises an amino acid sequence selected from the group consisting of SEQ ID NO: 911-949, and 950. In other embodiments, the HER2-binding DDpp comprises a variant of an amino acid sequence selected from the group consisting of SEQ ID NO: 911-949, and 950. In some embodiments, the DDpp comprises multiple target-binding domains (e.g., dimers, trimers, etc.). In some embodiments, the DDpp comprises 2, 3, 4, 5, or more than 5, DD, that bind HER2. In some embodiments, the DDpp comprises 2, 3, 4, 5, or more than 5, DD, that have the same sequence. In some embodiments, the DDpp comprises 2, 3, 4, 5 or more than 5, DD that bind to different epitopes of HER2. In some embodiments, the DDpp comprises a DD that specifically binds HER2 and further comprises 2, 3, 4, 5 or more than 5, additional different DDs or target-binding binding domains (e.g., scFvs) that bind to BCMA or a different target antigen. In some embodiments, the DDpp comprises a DD that specifically binds HER2 and further comprises one or more additional DDs or other target-binding binding domains that bind one or more antigens expressed on the surface of a cancer cell. In some embodiments, the DDpp comprises a DD that specifically binds HER2 and further comprises one or more additional DDs or other target-binding binding domains that bind one or more cancer antigens. In some embodiments, the DDpp specifically binds 2, 3, 4, 5, or more than 5, different targets. In further embodiments, the DDpp specifically binds 2, 3, 4, 5, or more than 5, different cancer antigens. In some embodiments, the DDpp specifically binds 2, 3, 4, 5, or more than 5, different cancer antigens expressed on the surface of a cancer cell. In some embodiments, the DDpp specifically binds 2, 3, 4, 5, or more than 5, cancer antigens expressed on the surface of different cancer cells.

In some embodiments, the DDpp is a fusion protein comprising a DD that specifically binds HER2. In some embodiments, the DD specifically binds a HER2 protein having an amino acid sequence consisting of SEQ ID NO: 967. In some embodiments, the DDpp comprises an amino acid sequence selected from the group consisting of SEQ ID NO: 911-949, and 950. In other embodiments, the HER2-binding DDpp fusion protein comprises a variant of an amino acid sequence selected from the group consisting of SEQ ID NO: 911-949, and 950. In some embodiments, the DDpp fusion protein comprises a full-length antibody or a portion (fragment) of an antibody. In some embodiments, the DDpp fusion protein comprises a full length IgG antibody (e.g., IgG1, IgG2, IgG2, or IgG4). In further embodiments, the DDpp comprises a commercially approved therapeutic antibody. In other embodiments, the HER2-binding DDpp is an Fc fusion protein.

In some embodiments, the DDpp fusion protein comprises a HER2-binding DD operably linked to a serum protein. In some embodiments, the DDpp fusion protein comprises an amino acid sequence selected from the group consisting of SEQ ID NO: 911-949, and 950. In other embodiments, the HER2-binding DDpp fusion protein comprises a variant of an amino acid sequence selected from the group consisting of SEQ ID NO: 911-949, and 950. In further embodiments, the DDpp fusion protein comprises human serum albumin or a fragment thereof. In some embodiments, the DDpp fusion protein comprises AFP or AFP p26, or a fragment thereof. In some embodiments, the DDpp fusion protein comprises AFP (e.g., SEQ ID NO: 9), or a fragment thereof. In other embodiments, the DDpp fusion protein comprises AFP p26 (SEQ ID NO: 10), or a fragment thereof.

In some embodiments, the HER2-binding DDpp fusion protein comprises the extracellular domain of a receptor or a fragment thereof. In some embodiments, the HER2-binding DDpp fusion protein comprises an amino acid sequence selected from the group consisting of SEQ ID NO: 911-949, and 950. In other embodiments, the HER2-binding DDpp fusion protein comprises a variant of an amino acid sequence selected from the group consisting of SEQ ID NO: 911-949, and 950. In further embodiments, the HER2-binding DDpp fusion protein comprises the extracellular domain of BCMA (SEQ ID NO: 7), CD123 (SEQ ID NO: 8), or CS1 (SEQ ID NO: 965), or a fragment thereof. In some embodiments, the HER2-binding DDpp fusion protein comprises the extracellular domain of a receptor selected from the group consisting of: CD19, CD20, CD22, HVEM, BTLA, DR3, CD37, CS-1, TSLPR, IL7R, and gp96, or a fragment thereof.

In additional embodiments, the HER2-binding DDpp fusion protein comprises an intracellular protein (e.g., a nuclear protein) or a fragment thereof. In some embodiments, the HER2-binding DDpp fusion protein comprises an amino acid sequence selected from the group consisting of SEQ ID NO: 911-949, and 950. In other embodiments, the HER2-binding DDpp fusion protein comprises a variant of an amino acid sequence selected from the group consisting of SEQ ID NO: 911-949, and 950.

In some embodiments, the HER2-binding DDpp fusion protein comprises a fragment of a serum protein (e.g., HSA, AFP, and AFP 26), an extracellular domain of a receptor (e.g., BCMA, CS1, CD123, and CD19), or an intracellular protein a nuclear protein), consisting of 5-500, 5-400, 5-300, 5-200, 5-100, 5-50, 10-500, 10-400, 10-300, 10-200, 10-100, or 10-50 amino acid residues.

In some embodiments, the DDpp fusion protein comprises a full length antibody. In further embodiments, the DDpp is a fusion protein comprising a full length antibody that specifically binds a cancer antigen. In further embodiments, the DDpp is a fusion protein comprising a full length antibody, wherein the antibody specifically binds a cancer antigen believed to be expressed by the cancer of the subject to which the DDpp fusion protein is administered.

In some embodiments, the disclosed DDpp (e.g., a DDpp fusion protein) is labeled. Labels that can be used to label the DDpp include but are not limited to an enzymatic label, a fluorescent label, a luminescent label, and a bioluminescent label. In some embodiments, the label is a biotin moiety. In some embodiments, the label is a streptavidin moiety. In some embodiments, the label is a His-tag or a FLAG tag. In some embodiments, the label is luciferase, green fluorescent protein, red fluorescent protein, or other similar agent.

In other embodiments, the DDpp fusion protein is attached to a solid support. In some embodiments, the solid support is selected from the group consisting of: a bead, a glass slide, a chip, a gelatin, and an agarose.

In some embodiments, the DDpp (e.g., a DDpp fusion protein) is associated with a liposome. In some embodiments, the DDpp is associated with the liposome through covalent binding. In some embodiments, DDpp is a fusion protein. In further embodiments, the DDpp is a CAR. In additional embodiments, the DDpp is associated with the liposome through ionic binding but not covalent binding.

In some embodiments, the target-binding DDpp is conjugated to a therapeutic or cytotoxic agent (e.g., a chemotherapeutic agent or a radiotherapeutic agent).

In additional embodiments, the disclosure provides a chimeric antigen receptor (CAR) which comprises a target binding domain comprising a DD disclosed herein (e.g., a DD comprising the amino acid sequence of SEQ ID NO: 11-949, or 950). In some embodiments, the DD binds BCMA and comprises an amino acid sequence selected from the group consisting of SEQ ID NO: 11-305, and 306. In some embodiments, the DD binds CD123 and comprises an amino acid sequence selected from the group consisting of SEQ ID NO: 307-739, and 740. In some embodiments, the DD binds AFP and comprises an amino acid sequence selected from the group consisting of SEQ ID NO: 741-874, and 886-895. In some embodiments, the DD binds AFP p26 and comprises an amino acid sequence selected from the group consisting of SEQ ID NO: 741-874, and 886-895. In some embodiments, the CAR comprises, a target binding domain, a transmembrane domain, and an intracellular signaling domain. In some embodiments, the CAR transmembrane domain comprises a 41BB or CD28 transmembrane domain. In some embodiments the CAR comprises an intracellular signaling domain selected from the group consisting of a domain of a human T cell receptor alpha, beta, or zeta chain; a human 41BB domain; a human CD28 domain; and any combination thereof. In some embodiments, the CAR intracellular signaling domain comprises the intracellular domain of a costimulatory molecule selected from the group consisting of CD27, CD28, 41BB, OX40, CD30, CD40, PD1, lymphocyte function-associated antigen-1 (LFA-1), CD2, CD7, LIGHT, NKG2C, B7-H3, a ligand that specifically binds with CD83, and any combination thereof. In some embodiments the CAR further comprises a second target binding domain having the same or a different target than the DD target binding domain. In some embodiments, the CAR is expressed in an immune cell. In some embodiments, the immune cell is a T cell (CAR-T cell) or a natural killer (NK) cell (CAR-NK cell). In some embodiments, the CAR is associated with a liposome.

In some embodiments, the CAR comprises 2, 3, 4, 5, or more than 5, DD and/or other binding domains (e.g., scFv) that specifically bind a target of interest (e.g., BCMA or CD123) expressed on the surface of the cancer cell. In additional embodiments, the CAR comprises 2, 3, 4, 5, or more than 5, DD or other binding domains (e.g., scFv) that specifically bind a second, different target of interest, expressed on the surface of the cancer cell. In additional embodiments, the administered CAR further comprises 2, 3, 4, 5, or more than 5, DD or other binding domains (e.g., scFv) that specifically binds a second, different target of interest, expressed by a second, different cancer cell or a vascular endothelial cell.

Nucleic acids encoding the disclosed DDpp (e.g., DDpp fusion proteins) are also provided. Additionally provided are vectors (e.g., plasmids, viral vectors, and non-viral vectors) containing nucleic acids encoding the DDpp (e.g., DDpp fusion proteins) and host cells containing the nucleic acids and vectors. In some embodiments, the vector comprises a nucleotide sequence which regulates the expression of the polypeptide encoded by the nucleic acid molecule. In further embodiments, the vector comprises an inducible promoter sequence. In additional embodiments, the vector includes one or more additional standard components for expression of a protein encoded a nucleic acid (e.g., promoters, packaging components, etc.). In some embodiments, the vector is a lentiviral vector.

The disclosure also provides host cells that comprise the nucleic acid molecules encoding a target-binding DDpp disclosed herein. In some embodiments, the host cells (e.g., cells of a cell line) are engineered to express a protein containing a DD disclosed herein (e.g., a DD having the amino acid sequence of SEQ ID NO: 11-949, or 950). In some embodiments, the expression of the DDpp by the host cells allows production and isolation of the DDpp. In some embodiments, the expression results in the DDpp being expressed on the surface and/or integral to the membrane of the host cells. In some embodiments, the host cell is a viral particle, or a bacterial, yeast, fungal, or plant cell. In other embodiments, the host cell is a mammalian cell. In a further embodiment, the mammalian cell is an immune cell. In one embodiment, the host cell is a human immune cell. In some embodiments, the human immune cell is a T cell. In other embodiments, the human immune cell is a natural killer (NK) cell. In some embodiments, the human immune cell displays the DDpp on its cell surface.

The disclosure further provides a host cell expressing a protein comprising a DD disclosed herein. In some embodiments, the host cell expresses a chimeric antigen receptor (CAR) comprising a DD disclosed herein. In some embodiments, the CAR comprises a target binding domain that comprises a DD that comprising an amino acid sequence selected from SEQ ID NO: 11-305, and 306; SEQ ID NO: 307-739, and 740; SEQ ID NO: 741-874 and 886-895; SEQ ID NO: 896-909 and 910; or SEQ ID NO: 911-949, and 950 and a transmembrane domain. In some embodiments, the CAR further comprise an intracellular domain (comprising a signaling domain). In some embodiments, the CAR immune cell is a T cell. In some embodiments, the CAR immune cell is a NK cell. In some embodiments, the CAR immune cell is not a T cell or an NK cell. In some embodiments, the host cell is an immune cell that further comprises a second CAR polypeptide having a DD or other binding domain (e g, scFv) that specifically binds the same or a different target (e.g., a different epitope of the same target, or a second target of interest) expressed by the cancer cell) as the first CAR expressed by the host immune cell.

Also provided are mammalian cells that generate membrane-bound virus-like particles (VLPs), wherein the mammalian cell is engineered to express a fusion protein comprising D domain polypeptide (DDpp) fused to a chimeric antigen receptor (CAR), the fusion protein being expressed on the generated VLPs (e.g., as transmembrane proteins). Depending on the embodiments, the VLPs produced by the mammalian cells are suitable for use as immunogens for antibody generation.

Pharmaceutical compositions containing a protein comprising a DD disclosed herein, nucleic acids encoding the proteins, vectors containing the nucleic acids, and host cells containing the nucleic acids and or vectors are also provided. As are kits containing one or more of the disclosed target-binding DDpps (e.g., DDpp fusion proteins such as DD-Fc and DD-CAR), nucleic acid molecules, vectors, and host cells (e.g., a therapeutic kit, a diagnostic kit, a kit for research use, etc.).

DDpp provided herein possess activities that include but are not limited to the ability to specifically bind a target of interest (e.g., a therapeutic target and/or diagnostic target such as BCMA, CD123, CS1, HER2, AFP, and AFP p26, a peptide tag, and a serum protein such as alpha-fetoprotein, human serum albumin (HSA) or an immunoglobulin) in vitro or in vivo and the ability to serve as a reactive site for linking or associating a protein such as a DDpp fusion protein with one or more additional moieties (e.g., a solid support), and/or other modifications. The DDpp provided herein can also possess additional desirable properties and/or functionalities useful in manufacturing, formulation and biological, diagnostic, and therapeutic applications.

In some embodiments, the DDpp is used to bind, detect, and/or quantitate, a target of interest (e.g., BCMA, CD123, CS1, HER2, AFP, or AFP p26) in a sample containing the target. In one embodiment, the disclosure provides a method for detecting a target of interest (e.g., BCMA, CD123, CS1, HER2, AFP, or AFP p26) in a sample, comprising: (a) contacting the sample with a DDpp containing a DD that comprises an amino acid sequence selected from the group consisting of SEQ ID NO: 11-949, and 950, that specifically binds the target, under conditions suitable for specific binding of the DDpp to the target, to form a target/DDpp complex, and (b) detecting the presence of the complex and/or captured target. In some embodiments, the DDpp is immobilized on a solid support. In some embodiments, the DD comprises an amino acid sequence selected from the group consisting of SEQ ID NO: 11-305 or 306, and the DDpp us used to bind, detect, and/or quantitate, BCMA or a fusion protein comprising BCMA in a sample. In some embodiments, the DD comprises an amino acid sequence selected from the group consisting of SEQ ID NO: 307-739 or 740, and the DDpp us used to bind, detect, and/or quantitate, CD123 or a fusion protein comprising CD123 in a sample. In some embodiments, the DD comprises an amino acid sequence selected from the group consisting of SEQ ID NO: 741-874 or 886-895, and the DDpp us used to bind, detect, and/or quantitate, AFP p26, or a fusion protein comprising AFP p26 in a sample. In some embodiments, the DD comprises an amino acid sequence selected from the group consisting of SEQ ID NO: 896-909 or 910, and the DDpp us used to bind, detect, and/or quantitate, CS1, or a fusion protein comprising CS1 in a sample. In some embodiments, the DD comprises an amino acid sequence selected from the group consisting of SEQ ID NO: 911-949 or 950, and the DDpp us used to bind, detect, and/or quantitate, HER2, or a fusion protein comprising HER2 in a sample.

Also provided is a method for quantifying a target of interest (e.g., BCMA, CD123, CS1, HER2, AFP, or AFP p26) in a sample containing the target, comprising: (a) contacting the sample with a DDpp containing a DD that comprises an amino acid sequence selected from the group consisting of SEQ ID NO: 11-949, and 950, that specifically binds the target and that is immobilized on a solid support, under conditions suitable for specific binding of the DDpp to the target, to form a target/DDpp complex and (b) detecting the presence of the target/DDpp complex and/or captured target, wherein quantitative detection of the product indicates, or is otherwise able to be correlated with, the quantity of the target or a fusion protein containing the target in the sample.

In additional embodiments, the provided DDpps are used in protein analytics. In some embodiments, the DDpps are conjugated to a detectable agent and/or tag. In some embodiments, the DDpp comprises an amino acid sequence selected from the group consisting of SEQ ID NO: 11-305, and 306; SEQ ID NO: 307-739, and 740; SEQ ID NO: 741-874 and 886-895; SEQ ID NO: 896-909 and 910; or SEQ ID NO: 911-949, and 950. In other embodiments, the DDpp comprises a variant of an amino acid sequence selected from the group consisting of SEQ ID NO: 11-305, and 306; SEQ ID NO: 307-739, and 740; or SEQ ID NO: 741-874 and 886-895; SEQ ID NO: 896-909 and 910; or SEQ ID NO: 911-949, and 950. In some embodiments, the DDpp is conjugated to a detectable agent. In one embodiment, the detectable agent comprises a chromogen. In another embodiment, the detectable agent comprises a fluorescent dye. In and additional embodiment, the detectable agent comprises a radionuclide. In some embodiments, the DDpp is conjugated to the detectable agent by covalent binding. In some embodiments, the DDpp is a fusion protein. In additional embodiments, the DDpp is multimeric. In additional embodiments, the DDpp is conjugated to a tag. In some embodiments, the tag is a member selected from the group consisting of: a polyhistidyl tag, a myc tag, and a FLAG tag. In further embodiments, the DDpp is conjugated to a combination of tags (e.g., a polyhistidyl tag and a FLAG tag). In some embodiments, the DDpp is conjugated to the tag(s) by covalent binding. In some embodiments, the DDpp is a fusion protein. In some embodiments, the DDpp is multimeric.

In additional embodiments, the DDpp is conjugated to a solid support or tag. In some embodiments, the solid support is a chromatography bead, resin, glass slide, chip, gelatin, or agarose.

Methods of using DDpp in diagnostic and therapeutic applications are also provided. In one embodiment, the disclosure provides a method of treating a disease or disorder comprising administering a therapeutically effective amount of a DDpp (e.g., a DDpp fusion protein) that specifically binds a therapeutic target of interest (e.g., BCMA, CD123, CS1, HER2, AFP, or AFP p26) to a subject in need thereof. In some embodiments, the disease or disorder is cancer, a B cell malignancy, a disease or disorder of the immune system, or an infection. Methods of treating a disease or disorder that comprises co-administering an additional therapeutic agent along with a disclosed DDpp are also provided. In some embodiments, the disease or disorder is multiple myeloma. In some embodiments, the disease or disorder is breast cancer or ovarian cancer.

The target binding DDpps disclosed herein have uses that include diagnostic and therapeutic applications. In some embodiments, the DDpps are useful in a therapeutic context, e.g., for treatment and/or diagnosis of a disease, such as a cancer (e.g., a solid or hematologic malignancy).

In some embodiments, the disclosure provides a method of treating a subject having cancer, the method comprising: administering to the subject a therapeutically effective amount of: a protein (i.e., DDpp) containing a DD disclosed herein (e.g., disclosed in Table 1, or having the amino acid sequence of SEQ ID NO: 11-949, or 950); a nucleic acid encoding the protein; a vector containing the nucleic acid; or a host cell containing the nucleic acid or vector. In some embodiments, the DDpp comprises a DD amino acid sequence that specifically binds BCMA. In some embodiments, a DD of the DDpp specifically binds BCMA having an amino acid sequence consisting of SEQ ID NO: 7. In further embodiments, the DDpp comprises an amino acid sequence selected from the group consisting of SEQ ID NO: 11-305, and 306. In some embodiments, the DDpp comprises a DD amino acid sequence that specifically binds CD123. In some embodiments, a DD of the DDpp specifically binds CD123 having an amino acid sequence consisting of SEQ ID NO: 8. In further embodiments, the DDpp comprises an amino acid sequence selected from the group consisting of SEQ ID NO: 307-739, and 740. In some embodiments, the DDpp comprises a DD amino acid sequence that specifically binds CS1. In some embodiments, a DD of the DDpp specifically binds CS1 having an amino acid sequence consisting of SEQ ID NO: 965. In further embodiments, the DDpp comprises an amino acid sequence selected from the group consisting of SEQ ID NO: 896-909, and 910. In some embodiments, the DDpp comprises a DD amino acid sequence that specifically binds HER2. In some embodiments, a DD of the DDpp specifically binds HER2 having an amino acid sequence consisting of SEQ ID NO: 967. In further embodiments, the DDpp comprises an amino acid sequence selected from the group consisting of SEQ ID NO: 911-949, and 950. In some embodiments, the DDpp comprises a DD amino acid sequence that specifically binds AFP. In some embodiments, a DD of the DDpp specifically binds AFP having an amino acid sequence consisting of SEQ ID NO: 9. In further embodiments, the DDpp comprises an amino acid sequence selected from the group consisting of SEQ ID NO: 741-874 and 886-895. In some embodiments, the DDpp specifically binds AFP p26 having an amino acid sequence consisting of SEQ ID NO: 10. In further embodiments, the DDpp comprises an amino acid sequence selected from the group consisting of SEQ ID NO: 741-874 and 886-895. In some embodiments, a DD of the DDpp specifically binds AFP p26 but does not specifically bind AFP having an amino acid sequence consisting of SEQ ID NO: 9. In further embodiments, the DDpp comprises an amino acid sequence selected from the group consisting of SEQ ID NO: 741-874 and 886-895.

In some embodiments, the disclosure provides a method of treating a subject having a B cell malignancy, said method comprising: administering to the subject an effective amount of: a protein containing a DD disclosed herein (e.g., disclosed in Table 1, or having the amino acid sequence of SEQ ID NO: 11-949, or 950); a nucleic acid encoding the protein; a vector containing the nucleic acid; or a host cell containing the nucleic acid or vector. In some embodiments, the B cell malignancy is selected from the group consisting of: a lymphoma (e.g., a. Hodgkin's lymphoma and non-Hodgkin's lymphoma (NHL), a leukemia, and a myeloma. In some embodiments, the B cell malignancy is selected from the group consisting of: acute lymphocytic leukemia, chronic lymphocytic leukemia, follicular lymphoma, mantle cell lymphoma, and diffuse large B-cell lymphoma, plasmacytoma, and multiple myeloma.

In some embodiments, the disclosure provides a method of treating a subject having cancer, the method comprising: administering to the subject an immune cell comprising a chimeric antigen receptor (CAR), wherein the CAR comprises: a target binding domain comprising a DD having an amino acid sequence selected from the group consisting of SEQ ID NO: 11-949, and 950, wherein the polypeptide specifically binds a target of interest and a transmembrane domain. In further embodiments, the target of interest is expressed by a cancer cell. In some embodiments, the DD specifically binds BCMA having an amino acid sequence consisting of SEQ ID NO: 7. In further embodiments, the DD comprises an amino acid sequence selected from the group consisting of SEQ ID NO: 11-305, and 306. In some embodiments, the DD specifically binds CD123 having an amino acid sequence consisting of SEQ ID NO: 8. In further embodiments, the DD comprises an amino acid sequence selected from the group consisting of SEQ ID NO: 307-739, and 740. In some embodiments, the DD specifically binds CS1 having an amino acid sequence consisting of SEQ ID NO: 965. In further embodiments, the DD comprises an amino acid sequence selected from the group consisting of SEQ ID NO: 896-909, and 910. In some embodiments, the DD specifically binds HER2 having an amino acid sequence consisting of SEQ ID NO: 967. In further embodiments, the DD comprises an amino acid sequence selected from the group consisting of SEQ ID NO: 911-949, and 950. In some embodiments, the DD specifically binds AFP p26 having an amino acid sequence consisting of SEQ ID NO: 10. In further embodiments, the DD comprises an amino acid sequence selected from the group consisting of SEQ ID NO: 741-874, and 886-895. In some embodiments, the CAR comprises an intracellular domain. In further embodiments, the intracellular domain comprises a signaling domain, wherein, upon administration to a subject having cancer, the target binding domain specifically binds to the target of interest expressed by a cancer cell (e.g., BCMA and CD123), and wherein the binding of the target of interest induces the immune cell to generate cytotoxic signals that result in cytotoxic effects on the cancer cell. In some embodiments, the immune cell is a T cell. In other embodiments, the immune cell is a NK cell. In some embodiments, the administered CAR immune cell is not a T cell or an NK cell. In further embodiments, a combination of different CAR immune cell types (e.g., NK cells and T cells) is administered to the subject. In some embodiments, the immune cell administration is intravenous. In some embodiments, a combination of different CAR immune cell types is administered intravenously to the subject. In some embodiments, the cancer is multiple myeloma. In some embodiments, the cancer is breast cancer or ovarian cancer.

In some embodiments, the disclosure provides a method of treating a subject having a B cell malignancy, said method comprising: administer to the subject an immune cell comprising a chimeric antigen receptor (CAR), wherein the CAR comprises: a target binding domain comprising a polypeptide having an amino acid sequence comprising, the polypeptide having an amino acid sequence selected from the group consisting of SEQ ID NO: 11-949, and 950, wherein the polypeptide specifically binds a target of interest expressed by a cancer cell, a transmembrane domain and an intracellular domain. In some embodiments, the target binding domain specifically binds BCMA having an amino acid sequence consisting of SEQ ID NO: 7. In further embodiments, the target binding domain comprises an amino acid sequence selected from the group consisting of SEQ ID NO: 11-305, and 306. In some embodiments, the target binding domain specifically binds CD123 having an amino acid sequence consisting of SEQ ID NO: 8. In further embodiments, the target binding domain comprises an amino acid sequence selected from the group consisting of SEQ ID NO: 307-739, and 740. In some embodiments, the target binding domain specifically binds CS1 having an amino acid sequence consisting of SEQ ID NO: 965. In further embodiments, the target binding domain comprises an amino acid sequence selected from the group consisting of SEQ II) NO: 896-909, and 910. In some embodiments, the CAR comprises an intracellular domain. In further embodiments, the intracellular domain comprises a signaling domain, wherein, upon administration to a subject having cancer, the target binding domain specifically binds to the target of interest expressed by a malignant B cell (e.g., BCMA, CS1, and CD123), and wherein the binding of the target of interest induces the immune cell to generate cytotoxic signals that result in cytotoxic effects on the malignant B cancer cell. In some embodiments, the B cell malignancy is selected from the group consisting of: a lymphoma (e.g., a Hodgkin's lymphoma and non-Hodgkin's lymphoma (NHL), a leukemia, and a myeloma. In some embodiments, the B cell malignancy is selected from the group consisting of: acute lymphocytic leukemia, chronic lymphocytic leukemia, follicular lymphoma, mantle cell lymphoma, diffuse large B-cell lymphoma, plasmacytoma and multiple myeloma. In some embodiments, the B cell malignancy is multiple myeloma. In some embodiments, the immune cell is a T cell. In other embodiments, the immune cell is a NK cell. In some embodiments, the administered CAR immune cell is not a T cell or an NK cell. In further embodiments, a combination of different CAR immune cell types (e.g., NK cells and T cells) is administered to the subject. In some embodiments, the immune cell administration is intravenous. In some embodiments, a combination of different CAR immune cell types is administered intravenously to the subject.

In some embodiments, the disclosure provides a method of treating a subject having a B cell associated disorder, said method comprising: administering to the subject an effective amount of: a protein containing a DD disclosed herein (e.g., a DD having an amino acid sequence disclosed in Table 1, or having the amino acid sequence of SEQ ID NO: 11-949, or 950); a nucleic acid encoding the protein; a vector containing, the nucleic acid; or a host cell containing the nucleic acid or vector.

In some embodiments, the disclosure provides a method of treating a subject having a disorder of the immune system, said method comprising: administering to the subject an effective amount of: a protein comprising a DD disclosed herein (e.g., a DD having an amino acid sequence disclosed in Table 1, or having the amino acid sequence of SEQ ID NO: 11-949, or 950); a nucleic acid encoding the protein; a vector containing the nucleic acid; or a host cell containing the nucleic acid or vector. In some embodiments, the disorder of the immune system is an autoimmune disease such as rheumatoid arthritis.

In some embodiments, the disclosure provides for the use of a composition for treating cancer, wherein the composition comprises: a protein containing a DD disclosed herein (e.g., a DD having an amino acid sequence disclosed in Table 1, or having the amino acid sequence of SEQ ID NO: 11-949, or 950); a nucleic acid encoding the protein; a vector containing the nucleic acid; or a host cell containing the nucleic acid or vector. In some embodiments, the cancer is a B cell malignancy. In some embodiments, the B cell malignancy is selected from the group consisting of: a lymphoma (e.g., a Hodgkin's lymphoma and non-Hodgkin's lymphoma (NHL), a leukemia, and a myeloma. In some embodiments, the B cell malignancy is selected from the group consisting of: acute lymphocytic leukemia, chronic lymphocytic leukemia, follicular lymphoma, mantle cell lymphoma, diffuse large B-cell lymphoma, plasmacytoma, and multiple myeloma. In some embodiments, the cancer is multiple myeloma. In some embodiments, the cancer is breast cancer or ovarian cancer.

In some embodiments, the disclosure provides for the use of a composition for treating a B cell malignancy, wherein the composition comprises: a protein containing a DI) disclosed herein (e.g., a DD having an amino acid sequence disclosed in Table 1, or having the amino acid sequence of SEQ ID NO: 11-949, or 950); a nucleic acid encoding the protein; a vector containing the nucleic acid; or a host cell containing the nucleic acid or vector. In some embodiments, the B cell malignancy is selected from the group consisting of: a lymphoma (e.g., a Hodgkin's lymphoma and non-Hodgkin's lymphoma (NHL), a leukemia, and a myeloma. In some embodiments, the B cell malignancy is selected from the group consisting of: acute lymphocytic leukemia, chronic lymphocytic leukemia, follicular lymphoma, mantle cell lymphoma, diffuse large B-cell lymphoma, plasmacytoma and multiple myeloma. In some embodiments, the B cell malignancy is multiple myeloma.

In some embodiments, the disclosure provides for the use of a composition for the treatment of a B cell associated disorder, wherein the composition comprises: a protein containing a DD disclosed herein (e.g., a DD having an amino acid sequence disclosed in Table 1, or having the amino acid sequence of SEQ ID NO: 11-949, or 950); a nucleic acid encoding the protein; a vector containing the nucleic acid; or a host cell containing the nucleic acid or vector.

In some embodiments, the disclosure provides for the use of a composition for the treatment of a disorder of the immune system, wherein the composition comprises: a protein containing a DD disclosed herein (e.g., a DD having an amino acid sequence disclosed in Table 1, or having the amino acid sequence of SEQ ID NO: 11-949, or 950); a nucleic acid encoding the protein; a vector containing the nucleic acid; or a host cell containing the nucleic acid or vector. In some embodiments, disorder of the immune system is an autoimmune disease such as rheumatoid arthritis.

In additional embodiments, the disclosure provides for use of an immune cell comprising a chimeric antigen receptor (CAR) for the treatment of cancer, wherein the CAR comprises: a target binding domain comprising a polypeptide having an amino acid sequence comprising, the polypeptide having an amino acid sequence selected from the group consisting of SEQ ID NO: 11-949, and 950, wherein the polypeptide specifically binds a target of interest expressed by a cancer cell, a transmembrane domain and an intracellular domain, wherein the intracellular domain comprises a signaling domain, wherein, upon administration to a subject having cancer, the target binding domain specifically binds to the target of interest expressed by a cancer cell, and wherein the binding of the target of interest induces the immune cell to generate cytotoxic signals that result in cytotoxic effects on the cancer cell. In some embodiments, the immune cell is a T cell or a natural killer (NK) cell. In some embodiments, the immune cell is a T cell. In some embodiments, the immune cell is a natural killer (NK) cell. In some embodiments, the immune cell is not a T cell or an NK cell. In further embodiments, a combination of different CAR immune cell types (e.g., T cells and NK cells) is used. In some embodiments, the cancer is multiple myeloma. In some embodiments, the cancer is breast cancer or ovarian cancer.

In additional embodiments, the disclosure provides for use of an immune cell comprising a chimeric antigen receptor (CAR) for the treatment of a B cell malignancy, wherein the CAR comprises: a target binding domain comprising a polypeptide having an amino acid sequence comprising, the polypeptide having an amino acid sequence selected from the group consisting of SEQ ID NO: 11-949, or 950, wherein the polypeptide, specifically binds a target of interest (e.g., a target expressed by a malignant B cell, such as BCMA, CS1, or CD123, wherein the target binding domain comprises an amino acid sequence selected from the group consisting of SEQ ID NO: 11-306, 307-740, and 896-910), a transmembrane domain and an intracellular domain, wherein the intracellular domain comprises a signaling domain, wherein, upon administration to a subject having cancer, the target binding domain specifically binds to the target of interest expressed by a malignant B cell, and wherein the binding of the target of interest induces the immune cell to generate cytotoxic signals that result in cytotoxic effects on the malignant B cell. In some embodiments, the immune cell is a T cell or a natural killer (NK) cell. In some embodiments, the immune cell is a T cell. In some embodiments, the immune cell is a natural killer (NK) cell. In some embodiments, the immune cell is not a T cell or an NK cell. In further embodiments, a combination of different CAR immune cell types (e.g., T cells and NK cells) is used. In some embodiments, the B cell malignancy is multiple myeloma.

In additional embodiments, the disclosure provides for use of an immune cell comprising a chimeric antigen receptor (CAR) for the treatment of a disorder of the immune system, wherein the CAR comprises: a target binding domain comprising a polypeptide having an amino acid sequence comprising, the polypeptide having an amino acid sequence selected from the group consisting of SEQ ID NO: 11-949, and 950, wherein the polypeptide specifically binds a target of interest expressed by the immune cell to be targeted, a transmembrane domain and an intracellular domain, wherein the intracellular domain comprises a signaling domain, wherein, upon administration to a subject having the disorder of the immune system, the target binding domain specifically binds to the target of interest expressed by the targeted immune cell, and wherein the binding of the target of interest induces the recombinant immune cell to generate cytotoxic signals that result in cytotoxic effects on the targeted immune cell. In some embodiments, the immune cell is a T cell or a natural killer (NK) cell. In some embodiments, the immune cell is not a T cell or an NK cell. In some embodiments, the immune cell is a natural killer (NK) cell. In some embodiments, the immune cell is not a T cell or an NK cell. In further embodiments, a combination of different CAR immune cell types (e.g., T cells and NK cells) is used.

The methods summarized above and/or set forth herein describe certain actions taken by a practitioner; however, it should be understood that they can also include the instruction of those actions by another party. Thus, actions such as "administering a T cell comprising a target specific binding polypeptide-CAR" include "instructing the administration of a T cell comprising a target specific binding polypeptide-CAR."

In some embodiments, the disclosure provides:
Gg
[1.] A protein comprising a D Domain (DD) target binding domain wherein the DD is a member selected from the group consisting of:
(a) a DD that specifically binds BCMA and comprises the amino acid sequence of SEQ ID NO: 11-305, or 306;
(b) a DD that specifically binds CD123 and comprises the amino acid sequence of SEQ ID NO: 307-739, or 740;
(c) a DD that specifically binds AFP and comprises the amino acid sequence of SEQ ID NO: 741-874, or 886-895;
(d) a DD that specifically binds AFP p26 and comprises the amino acid sequence of SEQ ID NO: 741-874, or 886-895;
(e) a DD that specifically binds CS1 and comprises the amino acid sequence of SEQ ID NO: 896-909, or 910; and
(f) a DD that specifically binds HER2 and comprises the amino acid sequence of SEQ ID NO: 911-949, or 950;
[2.] the protein of [1], wherein the DD is fused to a heterologous polypeptide;
[3.] the protein of [2], wherein the heterologous polypeptide comprises a full-length antibody or an antibody fragment;
[4.] the protein of [2], wherein the heterologous polypeptide comprises a member selected from the group consisting of:
(a) a transmembrane domain;
(b) a membrane associating domain;
(c) human serum albumin or a fragment thereof;
(d) AFP or a fragment thereof;
(e) AFP p26 or a fragment thereof; and
(f) the extracellular domain of a receptor or a fragment thereof;
[5.] the protein of [3], wherein the DD is fused to: the amino terminus of a full-length antibody heavy chain; the amino terminus of a full-length antibody light chain; the carboxyl terminus of a full-length antibody heavy chain; or the carboxyl terminus of a full-length antibody light chain;
[6.] the protein of [3], wherein the heterologous polypeptide is an Fc;
[7.] the protein of [2], wherein the heterologous polypeptide comprises the extracellular domain, or a fragment of an extracellular domain, of a receptor selected from the group consisting of: BCMA, CD123, CS1, and CD19;
[8.] the protein according to any one of [1]-[7], which is labeled;
[9.] the protein according to [9, wherein the label is selected from the group consisting of an enzymatic label, a fluorescent label, a luminescent label, a bioluminescent label and a biotin moiety;
[10.] a protein according to any one of [1]-[10], which conjugated to a therapeutic or cytotoxic agent;

[11.] a chimeric antigen receptor (CAR) which comprises a target binding domain comprising the protein according to any one of [1]-[5];

[12.] the CAR of [11], which comprises, a target binding domain, a transmembrane domain, and an intracellular signaling domain;

[13.] the CAR of [11] or [12], wherein transmembrane domain comprises a 41BB or CD28 transmembrane domain;

[14.] the CAR according to any one of [11]-[13], wherein the intracellular signaling domain is selected from the group consisting of a domain of a human T cell receptor alpha, beta, or zeta chain; a human 41BB domain; a human CD28 domain; and any combination thereof;

[15.] a CAR according to any one of [11]-[14], wherein the intracellular signaling domain comprises the intracellular domain of a costimulatory molecule selected from the group consisting of CD27, CD28, 41BB, OX40, CD30, CD40, PD1, lymphocyte function-associated antigen-1 (LFA-1), CD2, CD7, LIGHT, NKG2C, NKG2D, B7-H3, a ligand that specifically binds with CD83, and any combination thereof;

[16.] a protein according to any on of [1]-[15], which further comprises a second target binding domain having the same or a different target than the DD target binding domain;

[17.] an isolated nucleic acid encoding the protein according to any one of [1]-[16];

[18.] a vector comprising the nucleic acid of [17];

[19.] the vector of [18], wherein the nucleic acid is operably linked with a nucleotide sequence which regulates the expression of the protein encoded by the nucleic acid;

[20.] the vector of [19] which is a lentiviral vector;

[21.] a host cell comprising the nucleic acid according to [17] or the vector according to any one of [18-21;

[22.] a cell engineered to express the protein according to any one of [1]-[16];

[23.] a cell according to [21] or [22], wherein the cell is a T cell or a natural killer (NK) cell;

[24.] a pharmaceutical composition comprising the protein according to any one of [1]-[16], the nucleic acid of [17], the vector of [18], [19] or [20], or the cell according to any one of [21]-[23];

[25.] a kit comprising the protein according to any one of [1]-[16];

[26.] a method of treating a subject having cancer, the method comprising:
administering to the subject an effective amount of a protein according to any one of [1]-[16], the nucleic acid of [17], the vector of [18], [19] or [20], the cell according to any one of [21]-[23], or the pharmaceutical composition according to [24];

[26.] the method of [26], wherein the cancer is a B cell malignancy selected from the group consisting of: a lymphoma (e.g., a Hodgkin's lymphoma and non-Hodgkin's lymphoma (NHL), a leukemia, a plasmacytoma and a myeloma;

[28.] the method of [27], wherein the B cell malignancy is selected from the group consisting of: chronic lymphocytic leukaemia, follicular lymphoma, mantle cell lymphoma, and diffuse large B-cell lymphoma, plasmacytoma and multiple myeloma;

[27.] the method of [26], wherein the cancer is a myeloid malignancy selected from the group consisting of: chronic myeloid leukemia, acute myeloid leukemia, leukemia, plasmacytoma and myeloma;

[29.] a method of treating a subject having a B cell associated disorder (e.g., monoclonal gammapathy of determined significance), (MGUS)), the method comprising: administering to the subject an effective amount of a protein according to any one of [1]-[16], the nucleic acid of [17], the vector of [18], [19] or [20], the cell according to any one of [21]-[23], or the pharmaceutical composition according to [24];

[30.] a method of treating a subject having a disorder of the immune system, the method comprising: administering to the subject an effective amount of a protein according to any one of [1]-[16], the nucleic acid of [17], the vector of [18], [19] or [20], the cell according to any one of [21]-[23], or the pharmaceutical composition according to [24];

[31.] the method of [30], wherein the disorder of the immune system is an autoimmune disease such as rheumatoid arthritis;

[32.] a method of treating a subject having cancer, the method comprising:
administering an immune cell comprising a chimeric antigen receptor (CAR) to the subject, wherein the CAR comprises: a target binding domain comprising a DD having an amino acid sequence selected from the group consisting of SEQ ID NO: 11-949, and 950, optionally wherein the DD specifically binds a target of interest expressed by a cancer cell;
a transmembrane domain and an intracellular domain; wherein the intracellular domain comprises a signaling domain, and wherein, upon administration to a subject, the target binding domain specifically binds to the target of interest expressed by a cancer cell, and
wherein the binding of the target of interest induces the immune cell to generate cytotoxic signals that result in cytotoxic effects on the cancer cell;

[33.] the method of [32], wherein the immune cell is a T cell;

[34.] the method of [32], wherein the immune cell is a NK cell;

[35.] the method of [32] wherein the administration is intravenous;

[36.] use of a composition for treating cancer, wherein the composition comprises: a protein according to any one of [1]-[16], the nucleic acid of [17], the vector of [18], [19] or [20], or the cell according to any one of [21]-[23];

[37.] the use according to [36], wherein the cancer is a B cell malignancy;

[38.] the use according to [37], wherein the B cell malignancy is selected from the group consisting of: a lymphoma (e.g., a Hodgkin's lymphoma and non-Hodgkin's lymphoma (NHL), a leukemia, and a myeloma;

[39.] the use according to [38], wherein the B cell malignancy wherein the B cell malignancy is selected from the group consisting of: chronic lymphocytic leukaemia, follicular lymphoma, mantle cell lymphoma, and diffuse large B-cell lymphoma;

[40.] use of a composition for the treatment of a B cell associated disorder, wherein the composition comprises: a protein according to any one of [1]-[16], the nucleic acid of [17], the vector of [18], [19] or [20], the cell according to any one of [21]-[23], or the pharmaceutical composition according to [24]

[41.] use of a composition for the treatment of a disorder of the immune system, wherein the composition comprises: a protein according to any one of [1]-[16], the nucleic acid of [17], the vector of [18], [19] or [20], the cell according to any one of [21]-[23], or the pharmaceutical composition according to [24]

[42.] the use according to [41], wherein the disorder of the immune system is an autoimmune disease such as rheumatoid arthritis;

[43.] use of an immune cell comprising a chimeric antigen receptor (CAR) for the treatment of cancer, wherein the CAR comprises: a target binding domain comprising a DD comprising an amino acid sequence selected from the group consisting of SEQ ID NO: 11-949, or 950, and optionally wherein the target binding domain specifically binds a target of interest expressed by a cancer cell,
a transmembrane domain and an intracellular domain, wherein the intracellular domain comprises a signaling domain, wherein, upon administration to a subject having cancer, the target binding domain specifically binds to the target of interest expressed by a cancer cell, and
wherein the binding of the target of interest induces the immune cell to generate cytotoxic signals that result in cytotoxic effects on the cancer cell;

[44.] the use according to [43], wherein the immune cell is a T cell or a natural killer (NK) cell.

BRIEF DESCRIPTION OF THE DRAWINGS

FIGS. 2A-2F. CD123-DDpp-CAR T cells produce cytokines in response to target binding. FIGS. 2A and 2B show data related to the production of interferon gamma (IFNγ) by T cells expressing CD123-DDpp-CARs when co-cultured with CD123 negative tumor K562 and CD123 positive tumor BDCM, respectively. FIGS. 2C and 2D depicts similar data measuring the production of interleukin-2 (IL2) by CD123-DDpp-CAR T cells when co-cultured with K562 and BDCM, respectively. FIGS. 2E and 2F show similar target-driven cytokine (IFNγ, IL2) by PD-L1-DDppCAR T cells when co-cultured with PDL1 expressing tumor cells (SUDHL-1).

FIG. 3A depicts expression of three exhaustion markers (LAG3, PD1, and TIM3) on T cells expressing various DDpp-CARs at similar levels of the expression of those markers on scFv-CAR 32716 (32716 (Du X1, Ho M, Pastan I. 2007. New immunotoxins targeting CD123, a stem cell antigen on acute myeloid leukemia cells. J Immunother. 30(6): 607-13). FIG. 3B shows flow cytometry data depicting similar exhaustion marker expression on DDpp-CAR T cells (expressing CD123 targeting cg06 DDpp) as compared to a CAR T cell expressing CD123-specific scFv (32716).

FIGS. 4A-4C. T cells expressing DDpp-CARs (CD123-targeting) undergo degranulation when co-cultured with target-expressing tumor cells (BDCM). FIGS. 4A-4C show results obtained by culturing T cells alone (FIG. 4A) or in the presence of K562 (FIG. 4B) or BDCM (FIG. 4C) cells.

FIG. 5A shows data related to CD123-DDpp-CAR T cells kill percentage of K562 tumor cells that are negative for CD123. FIG. 5B shows kill percentages when the CD123 targeting DDpp-CAR T cells are co-cultured with CD123 positive BDCM cells. The data from FIGS. 5A and 5B were generated using T cells from a first donor blood sample. FIGS. 5C and 5D show similar data from T cells collected from a second donor.

FIGS. 6A-6E. Bi-specific DDpp-CAR T cells. FIG. 6A shows the percentage of T cells expressing CD123 targeting DDpp-CARs (cg06). FIG. 6B shows the percentage of T cells expressing PDL1 targeting DDpp-CARs (pb04). FIG. 6C shows the percentage of T cells expressing bi-specific CD123-PDL1 targeting DDpp-CARs (expressed with cg06 DDpp distal to the T cell membrane versus the pb04 DDpp). FIG. 6D shows the percentage of T cells expressing bi-specific PDL1-CD123 targeting DDpp-CARs (expressed with pb04 DDpp distal to the T cell membrane versus the cg06 DDpp). FIG. 6E depicts data related to the increased intracellular signaling of bispecific DDpp.

FIGS. 7A and 7B show that dual-binding domain adaptor proteins drive enhanced signaling by CAR-expressing Jurkat NFAT-Luciferase reporter cells over single-binding domain adaptor proteins. In FIG. 7A, 50,000 reporter cells previously transduced with an AFP (p26 domain)-binding CAR (af03) were cultured for 5 hours in the presence of the CD123-specific Cg06-adaptor (Cg06-p26) or the Cg06-dual adaptor protein (Cg06-p26-Cg06 in the presence of 50,000 CD123$^+$ MOLM13 or CD123-deficient MOLM13 cells, then assessed for luciferase activity. CD123 deficient cells were generated using CRISPR/Cas9 genetic engineering technology. In FIG. 7B, 50,000 reporter cells previously transduced with an AFP (p26 domain)-binding CAR (af03) were cultured for 5 hours in the presence of the BCMA-specific Bc40-adaptor (Bc40-p26) or the Bc40-dual adaptor protein (Bc40-p26-Bc40) in the presence or absence of 50,000 BCMA$^+$ U266 cells, then assessed for luciferase activity.

DETAILED DESCRIPTION

Figure 1A:
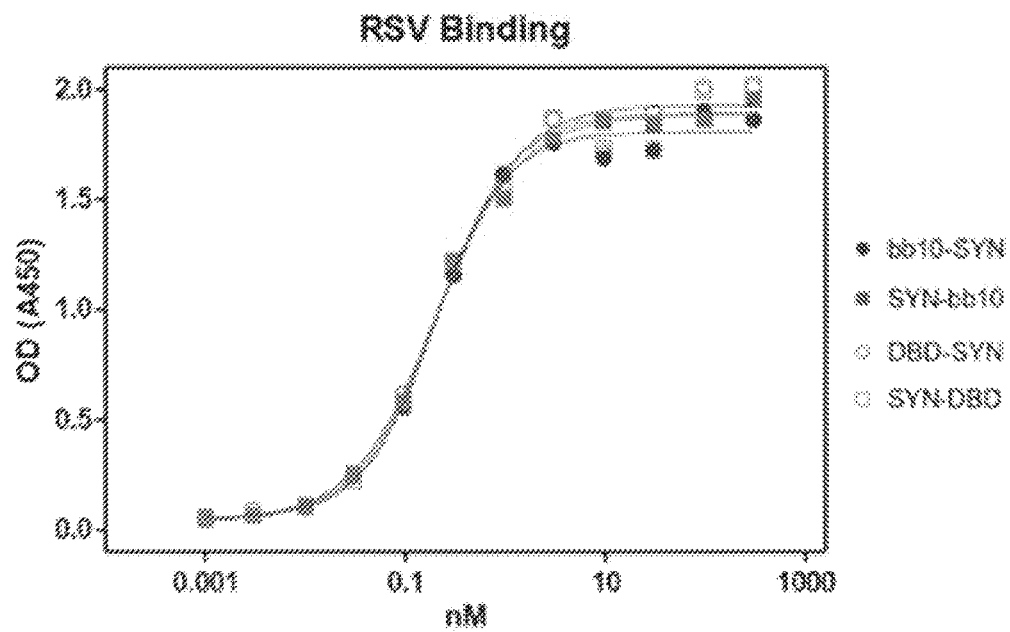
FIGS. 1A-1B, DDpp impart novel binding specificities to another molecule (e.g., a full length antibody) as part of a fusion protein (e.g., an antibody-DDpp fusion protein. DDpp-antibody fusions were created using an RSV-specific antibody (SYN) and either the target-less peptide of SEQ ID NO: 1 (DD) or the CD137-specific DDpp (bb10) (SEQ ID NO: 876). The DDpp are fused to the N-terminus (bb10-SYN and DD-SYN) or the C-terminus (SYN-bb10 and SYN-DD). All four antibody fusions bind to RSV (FIG. 1A). However, the fusion of bb10 to either the N-terminus (bb10-SYN) or C-terminus (SYN-bb10) of the antibody heavy chain imparts a novel CD137 binding specificity to an otherwise mono-specific antibody (FIG. 1B).

The section headings used herein are for organizational purposes only and are not to be construed as in any way limiting of the subject matter described.

Definition of Terms

It is understood that wherever embodiments, are described herein with the language "comprising" otherwise analogous embodiments, described in terms of "consisting of" and/or "consisting essentially of" are also provided. However, when used in the claims as transitional phrases, each should be interpreted separately and in the appropriate legal and factual context (e.g., "comprising" is considered more of an open-ended phrase while "consisting of" is more exclusive and "consisting essentially of" achieves a middle ground).

As used herein, the singular form "a", "an", and "the" includes plural references unless indicated otherwise.

The term "and/or" as used in a phrase such as "A and/or B" herein is intended to include both A and B; A or B; A (alone); and B (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

The terms "protein" and "polypeptide" are used interchangeably herein to refer to a biological polymer comprising units derived from amino acids linked via peptide bonds; a protein can be composed of two or more polypeptide chains.

The terms "antibody" or "immunoglobulin," as used interchangeably herein, include full-length antibodies and antibody fragments including any functional domain of an antibody such as an antigen-binding fragment or single chains thereof, an effector domain, salvage receptor binding epitope, or portion thereof. A typical antibody comprises at least two heavy (H) chains and two light (L) chains interconnected by disulfide bonds. Each heavy chain is comprised of a heavy chain variable region (abbreviated herein as VH) and a heavy chain constant region. The heavy chain constant region is comprised of three domains, CH1, CH2, and CH3. Each light chain is comprised of a light chain variable region (abbreviated herein as VL) and a light chain constant region. The light chain constant region is comprised of one domain, Cl. The VH and VL regions can be further subdivided into regions of hypervariablity, termed Complementarity Determining Regions (CDRs), interspersed with regions that are more conserved, termed framework regions (FW). Each VH and VL is composed of three CDRs and four FWs, arranged from amino-terminus to carboxyl-terminus in the following order: FW1, CDR1, FW2, CDR2, FW3, CDR3, FW4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (C1q) of the classical complement system. Examples of antibodies of the present disclosure include typical antibodies, scFvs, and combinations thereof where, for example, a DDpp is covalently linked (e.g., via peptide bonds or via a chemical linker) to the N-terminus of either the heavy chain and/or the light chain of a typical whole (full-length) antibody, or intercalated in the H chain and/or the L chain of a full-length antibody.

The term "antibody fragment" refers to a portion of an intact antibody and refers to any functional domain of an antibody such as an antigen-binding fragment or single chains thereof, an effector domain or a portion thereof, and a salvage receptor binding epitope or a portion thereof. Examples of antibody fragments include, but are not limited to, Fab, Fab', F(ab')2, and Fv fragments, linear antibodies, single chain antibodies, and multi-specific antibodies formed from antibody fragments. "Antibody fragment" as used herein comprises an antigen-binding site or epitope binding site. In one embodiment, the DDpp fusion protein comprises an effector domain or portion thereof. In one embodiment, the DDpp fusion protein comprises a salvage receptor binding epitope, or portion thereof.

As used herein, the term, "Fc region" or simply "Fc" is understood to mean the carboxyl-terminal portion of an immunoglobulin chain constant region, preferably an immunoglobulin heavy chain constant region, or a portion thereof. For example, an immunoglobulin Fc region may comprise (1) a CH1 domain, a CH2 domain, and a CH3 domain, (2) a CH1 domain and a CH2 domain, (3) a CH1 domain and a CH3 domain, 4) a CH2 domain and a CH3 domain, or (5) a combination of two or more domains and an immunoglobulin hinge region. Thus, in various embodiments, Fc refers to the last two constant region immunoglobulin domains of IgA, IgD, and IgG, and the last three constant region immunoglobulin domains of IgE and IgM, and the flexible hinge N-terminal to these domains. For IgA and IgM Fc may include the J chain. For IgG, Fc comprises immunoglobulin domains $C\gamma 2$ and $C\gamma 3$ and the hinge between $C\gamma 1$ and $C\gamma 2$. In a preferred embodiment the immunoglobulin Fc region comprises at least an immunoglobulin hinge region a CH2 domain and a CH3 domain, and preferably lacks the CH1 domain. In one embodiment, the class of immunoglobulin from which the heavy chain constant region is derived is IgG (Ig$\gamma$) ($\gamma$ subclasses 1, 2, 3, or 4). Other classes of immunoglobulin, IgA (Ig$\alpha$), IgD (Ig$\delta$), IgE (Ig$\epsilon$) and IgM (Ig$\mu$), may be used. Although the boundaries of the Fc region may vary, the human IgG heavy chain Fc region is usually defined to comprise residues C226 or p260 to its carboxyl-terminus, wherein the numbering is according to the EU index as set forth in Kabat (Kabat et al., Sequences of Proteins of Immunological Interest, 5th Ed. Public Health Service, NIH, Bethesda, Md. (1991)). Fc may refer to this region in isolation, or this region in the context of a full-length antibody, antibody fragment, or Fc fusion protein. Polymorphisms have been observed at a number of different Fc positions, including but not limited to positions 270, 272, 312, 315, 356, and 358 as numbered by the EU index, and thus slight differences between the presented sequence and sequences in the prior art may exist. The choice of appropriate immunoglobulin heavy chain constant region is discussed in detail in U.S. Pat. Nos. 5,541,087, and 5,726,044, each of which is herein incorporated by reference in its entirety. The choice of particular immunoglobulin heavy chain constant region sequences from certain immunoglobulin classes and subclasses to achieve a particular result is considered to be within the level of skill in the art. The portion of the DNA construct encoding the immunoglobulin Fc region preferably comprises at least a portion of a hinge domain, and preferably at least a portion of a CH3 domain of Fc gamma or the homologous domains in any of IgA, IgD, IgE, or IgM. Furthermore, it is contemplated that substitution or deletion of amino acids within the immunoglobulin heavy chain constant regions may be useful in the practice of the methods and compositions disclosed herein. One example would be to introduce amino acid substitutions in the upper CH2 region to create an Fc variant with reduced affinity for Fc receptors (Cole, J. Immunol. 159: 3613 (1997)).

"Antibody-dependent cell-mediated cytotoxicity" or "ADCC" refer to a cell-mediated reaction in which nonspecific cytotoxic cells that express Fc receptors (FcRs) (e.g., Natural Killer (NK) cells, neutrophils, and macrophages) recognize bound antibody on a target cell and subsequently cause lysis (or other cytotoxic effects) of the target cell. To assess ADCC activity of a molecule of interest, any in vitro ADCC assay known in the art can be used, such as that described in U.S. Pat. No. 5,500,362 or 5,821,337. Useful effector cells for such assays include, but are not limited to, peripheral blood mononuclear cells (PBMC) and Natural Killer (NK) cells. Alternatively, or additionally, ADCC activity of the molecule of interest can be assessed in vivo, e.g., in an animal model such as that disclosed in Clynes et al. PNAS 95: 652-656 (1998).

The terms "single chain variable fragment(s)," or "scFv" antibodies as used herein refer to forms of antibodies (e.g., antibody fragments) comprising the variable regions of only the heavy and light chains, connected by a linker peptide. In one embodiment, a DDpp fusion protein comprises a DDpp and a scFv.

The term "linker" refers to a peptide or other chemical linkage located between a DDpp and another polypeptide of a DDpp fusion protein. Suitable linkers for coupling the two or more linked DDpp will be clear to the persons skilled in the art and non-limiting examples are described herein.

The term "operably linked," as used herein, indicates that two molecules are attached so as to each retain at least some level of functional activity that each molecule had alone (assuming that each molecule had a function activity). In embodiments, when one molecule was without functional activity, it is operably linked with another molecule if the other molecule retains at least some level of its functional activity. Operably linked can also refer to linkage of two non-functional molecules. Two molecules can be "operably linked" whether they are attached directly or indirectly (e.g., via a linker).

The terms "specifically binds," "having selective affinity for," "binds," or "binding" are used interchangeably to mean that a binding agent such as a DDpp reacts or associates more frequently, more rapidly, with greater duration, with greater affinity, or with some combination of the above, to the epitope, protein, or target molecule than with alternative substances, including proteins unrelated to the target epitope, protein, or target molecule. Because of the sequence identity between homologous proteins in different species, specific binding can, in some embodiments, include a binding agent that recognizes a protein or target in more than one species. Likewise, because of homology within certain regions of polypeptide sequences of different proteins, specific binding can include a binding agent that recognizes more than one protein or target. It is understood that, in certain embodiments, a binding agent that specifically binds a first target may or may not specifically bind a second target. As such, "specific binding" does not necessarily require (although it can include) exclusive binding, e.g., binding to a single target. Thus, a binding agent may, in certain embodiments, specifically bind more than one target. In certain embodiments, multiple targets may be bound by the same antigen-binding site on the binding agent.

"Target" refers to any molecule or combination of molecules that can be bound by a DDpp such as a DDpp fusion protein, or other component of the DDpp fusion protein such as an antibody or antibody variable domain fragment.

The terms "epitope" and "antigenic determinant" are used interchangeably herein and refer to that portion of any molecule (e.g., a target of interest such as BCMA, CD123, AFP, or AFP p26) capable of being recognized and specifically bound by a particular binding agent (e.g., an DDpp or antibody). When the recognized molecule is a polypeptide, epitopes can be formed from contiguous amino acids and noncontiguous amino acids and/or other chemically active surface groups of molecules (such as carbohydrates) juxtaposed by tertiary folding of a protein. Epitopes formed from contiguous amino acids are typically retained upon protein denaturing, whereas epitopes formed by tertiary folding are typically lost upon protein denaturing. An epitope typically includes at least 3 amino acids, and more usually, at least 5 or 8-10 amino acids in a unique spatial conformation.

A "peptide tag" as used herein refers to a peptide sequence that is part of or attached (for instance through genetic engineering) to another protein, to provide a function to the resultant fusion. Peptide tags are usually relatively short in comparison to a protein to which they are fused; by way of example, peptide tags are, in some embodiments, four or more amino acids in length, such as, 5, 6, 7, 8, 9, 10, 15, 20, or 25 or more amino acids. In some embodiments, the DDpp is a fusion protein that contains a peptide tag. In other embodiments, the DDpp specifically binds a peptide tag. Numerous peptide tags that have uses as provided herein are known in the art. Examples of peptide tags that may be a component of a DDpp fusion protein or a target bound by a DDpp (e.g., a DDpp fusion protein) include but are not limited to HA (hemagglutinin), c-myc, the Herpes Simplex virus glycoprotein D (gD), T7, GST, GFP, MBP, Strep-tags, His-tags, Myc-tags, TAP-tags and FLAG® tag (Eastman Kodak, Rochester, N.Y.) Likewise, antibodies to the tag epitope allow detection and localization of the fusion protein using techniques known in the art, such as, Western blots, ELISA assays, and immunostaining of cells.

The term "naturally occurring" when used in connection with biological materials such as a nucleic acid molecules, polypeptides, and host cells, refers to those which are found in nature and not modified by a human being. Conversely, "non-natural" or "synthetic" when used in connection with biological materials refers to those materials which are not found in nature and have been modified by a human being.

As used herein "modifications" with respect to the sequence of a reference sequence includes substitutions, deletions insertions and/or additions of the sequence of the corresponding amino acid position of the reference sequence (e.g., a DD disclosed herein).

A "substitution" with respect to the sequence of a reference sequence refers to a replacement of a particular amino acid residue with a different amino acid residue at a corresponding amino acid position of the reference sequence.

A "conservative" amino acid substitution is one in which one amino acid residue is replaced with another amino acid residue having a similar side chain Families of amino acid residues having similar side chains have been defined in the art, including basic side chains (e.g., lysine (K), arginine (R), histidine (H)), acidic side chains (e.g., aspartic acid (D), glutamic acid (E)), uncharged polar side chains (e.g., glycine (G), asparagine (N), glutamine (Q), serine (S), threonine (T), tyrosine (Y), cysteine (C)), nonpolar side chains (e.g., alanine (A), valine (V), leucine (L), isoleucine (I), proline (P), phenylalanine (F), methionine (M), tryptophan (W), beta-branched side chains (e.g., threonine (T), valine (V), isoleucine (I)) and aromatic side chains (e.g., tyrosine (Y), phenylalanine (F), tryptophan (W), histidine (H)). For example, substitution of a phenylalanine for a tyrosine is a conservative substitution. In particular embodiments, conservative substitutions in the sequences of the DDpp result in the altered or unaltered specific binding of the DDpp containing the substitution to the target of interest (e.g., BCMA, CD123, AFP, or AFP p26) to which it binds. In one embodiment, conservative substitutions in the sequences of the DDpp do not abrogate the binding of the DDpp containing the substitution to the target of interest to which it binds. Methods of identifying nucleotide and amino acid conservative substitutions and non-conservative substitutions which confer, alter or maintain selective binding affinity are known in the art (see, e.g., Brummell, Biochem. 32: 1180-1187 (1993); Kobayashi, Protein Eng. 12(10): 879-884 (1999); and Burks, PNAS 94: 412-417 (1997)).

A "non-conservative" amino acid substitution is one in which one amino acid residue is replaced with another amino acid residue having a dissimilar side chain. In one embodiment, non-conservative substitutions in the sequences of the DDpp result in the specific binding of the DDpp containing the substitution to the target of interest (e.g., BCMA, CD123, AFP, or AFP p26) to which it binds. In one embodiment, non-conservative substitutions in the sequences of the DDpp do not abrogate the binding of the DDpp containing the substitution to the target of interest to which it binds.

"Non-natural amino acids," "amino acid analogs" and "non-standard amino acid residues" are used interchangeably herein. Non-natural amino acids that can be substituted in a DDpp as provided herein are known in the art. In one embodiment the non-natural amino acid is 4-hydroxyproline which can be substituted for proline; 5-hydroxylysine which can be substituted for lysine; 3-methylhistidine which can be substituted for histidine; homoserine which can be substituted for serine; and ornithine which can be substituted for lysine. Additional examples of non-natural amino acids that can be substituted in a DDpp disclosed herein include, but are not limited to molecules such as: D-isomers of the common amino acids, 2,4-diaminobutyric acid, alpha-amino isobutyric acid, A-aminobutyric acid, Abu, 2-amino butyric acid, gamma-Abu, epsilon-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, beta-alanine, lanthionine, dehydroalanine, γ-aminobutyric acid, selenocysteine and pyrrolysine fluoro-amino acids, designer amino acids such as beta-methyl amino acids, C alpha-methyl amino acids, and N alpha-methyl amino acids, or combinations of non-natural amino acids. Additional non-natural amino acids can include for example, 4-amino butyric acid, 4-amino-3-hydroxy-5-phenylpentanoic acid, 4-amino-3-hydroxy-6-methylheptanoic acid, 2-thienyl alanine, and/or D-isomers of amino acids. As discussed herein, in some embodiments, non-natural amino acids or amino acid analogs can include deletion of one or more amino acids from a sequence.

The terms "polynucleotide" and "nucleic acid," used interchangeably herein, refer to a polymeric form of nucleotides of any length, either ribonucleotides or deoxyribonucleotides. These terms include, but are not limited to, DNA, RNA, cDNA (complementary DNA), mRNA (messenger RNA), rRNA (ribosomal RNA), shRNA (small hairpin RNA), snRNA (small nuclear RNA), snoRNA (short nucleolar RNA), miRNA (microRNA), genomic DNA, synthetic DNA, synthetic RNA, and/or tRNA.

The term "naked DNA" as used herein refers to DNA (e.g., histone free DNA) encoding a protein such as a DDpp (e.g., a CAR) disclosed herein is a DNA that is cloned in a suitable expression vector in proper orientation for expression (e.g., a plasmid). Viral vectors which can be used to carry and/or express DNA encoding the DDpp include but are not limited to SIN lentiviral vectors, retroviral vectors, foamy virus vectors, adenovirus vectors, adeno-associated virus (AAV) vectors, hybrid vectors and/or plasmid transposons (for example sleeping beauty transposon system) or integrase based vector systems. Other vectors that can be used in connection with making and using DDpp are described herein or otherwise known in the art.

The terms "vector", "cloning vector" and "expression vector" as used herein refer to the vehicle by which a nucleic acid sequence (e.g., a disclosed DDpp coding sequence) can be maintained or amplified in a host cell (e.g., cloning vector) or introduced into a host cell, so as to transform the host and promote expression (e.g., transcription and translation) of the introduced sequence. Vectors include plasmids, phages, viruses, etc.

A "host cell" includes an individual cell or cell culture which can be or has been a recipient of nucleic acids encoding a disclosed DDpp. Host cells includes but are not limited to viral particles, phagemids, bacteria, yeast plant, animal, and mammalian cells. Host cells include progeny of a single host cell, and the progeny may not necessarily be completely identical (in morphology or in total DNA complement) to the original parent cell due to natural, accidental, or deliberate mutation and/or change. A host cell includes cells transfected or infected in vivo, in vitro, or ex vivo with nucleic acids encoding a disclosed DDpp. In some examples, the host cell is capable of expressing and displaying a disclosed DDpp on its surface, such as for example, in phage display or a CAR T cell. "Expression" includes transcription and/or translation.

As used herein, the terms "solid support," "support," "matrices," and "resins" are used interchangeably and refer to, without limitation, any column (or column material), bead, test tube, microtiter dish, solid particle (for example, agarose or sepharose), microchip (for example, silicon, silicon-glass, or gold chip), or membrane (e.g., biologic or filter membrane) to which a DDpp, antibody, or other protein may be attached (e.g., coupled, linked, or adhered), either directly or indirectly (for example, through other binding partner intermediates such as other antibodies or Protein A), or in which a DDpp or antibody may be embedded (for example, through a receptor or channel). Reagents and techniques for attaching polypeptides to solid supports (e.g., matrices, resins, plastic, etc.) are well known in the art. Suitable solid supports include, but are not limited to, a chromatographic resin or matrix (e.g., SEPHAROSE-4 FF agarose beads), the wall or floor of a well in a plastic microtiter dish, a silica based biochip, polyacrylamide, agarose, silica, nitrocellulose, paper, plastic, nylon, metal, and combinations thereof. DDpp and other compositions may be attached on a support material by a non-covalent association or by covalent bonding, using reagents and techniques known in the art. In one embodiment, the DDpp is coupled to a chromatography material using a linker.

As used herein, the terms "pharmaceutically acceptable," or "physiologically tolerable" and grammatical variations thereof, as they refer to compositions, carriers, diluents and reagents, are used interchangeably and represent that the materials are capable of administration to or upon a human without the production of therapeutically prohibitive undesirable physiological effects such as nausea, dizziness, gastric upset and the like.

"Modulate," means adjustment or regulation of amplitude, frequency, degree, or activity. In another related aspect, such modulation may be positively modulated (e.g., an increase in frequency, degree, or activity) or negatively modulated (e.g., a decrease in frequency, degree, or activity). In some embodiments, modulation in a positive or negative direction is referenced as compared to the cell, tissue, or organ function prior to administration of a therapeutic. In additional embodiments, modulation in a positive or negative direction is referenced with respect to a normal, healthy cell, tissue or organ.

An "effective amount" of a DDpp such as a DDpp fusion protein as provided herein, is an amount sufficient to carry out a specifically stated purpose such as to bring about an observable change in the level of one or more biological activities related to the target to which the DDpp (e.g., a DDpp fusion protein) binds. In certain embodiments, the change increases the level of target activity. In other embodiments, the change decreases the level of target activity. An "effective amount" can be determined empirically and in a routine manner, in relation to the stated purpose. The term "therapeutically effective amount" refers to an amount of a DDpp such as a DDpp fusion protein, or other therapeutic agent effective to "treat" (e.g., reduce symptoms of) a disease or disorder in a subject (mammal). The term "therapeutically effective amount" also refers to an amount effective, at dosages and for periods of time necessary, to achieve a desired prophylactic result.

"Patient," "subject," "animal" and "mammal" are used interchangeably and refer to mammals such as human patients and non-human primates, as well as experimental animals such as rabbits, rats, and mice, and other animals. Animals include all vertebrates, e.g., mammals and non-mammals, such as chickens, amphibians, and reptiles. "Mammal" as used herein refers to any member of the class Mammalia, including, without limitation, humans and non-human primates such as chimpanzees and other apes and monkey species; farm animals such as cattle, sheep, pigs, goats and horses; domestic mammals such as dogs and cats; laboratory animals including rodents such as mice, rats and guinea pigs, and the like. In a particular embodiment, the patient is a human. The term does not denote a particular age or sex. Thus, adult and newborn subjects, as well as embryos and fetuses, whether male or female, are intended to be included within the scope of this term.

The terms "treat," "treatment," and "treating," as used herein refer to both therapeutic treatment and prophylactic or preventative measures, wherein the object is to prevent or slow down (lessen or delay) the symptoms, complications, or biochemical indicia of a disease, condition, or disorder, alleviating the symptoms or arresting or inhibiting further development of the disease, condition, or disorder. Treatment can be prophylactic (to prevent or delay the onset of the disease, or to prevent the manifestation of clinical or subclinical symptoms thereof) or therapeutic suppression or alleviation of symptoms after the manifestation of the disease, condition, or disorder targeted pathologic condition, prevent the pathologic condition, pursue or obtain beneficial results, or lower the chances of the individual developing the condition even if the treatment is ultimately unsuccessful. Those in need of treatment include those already with the condition as well as those prone to have the condition or those in whom the condition is to be prevented. Treatment can be with a DDpp fusion protein alone or in combination with an additional therapeutic agent.

"Cancer," "tumor," or "malignancy" are used as synonymous terms and refer to any of a number of diseases that are characterized by uncontrolled, abnormal proliferation of cells, the ability of affected cells to spread locally or through the bloodstream and lymphatic system to other parts of the body (metastasize) as well as any of a number of characteristic structural and/or molecular features. "Tumor," as used herein refers to all neoplastic cell growth and proliferation, whether malignant or benign, and all pre-cancerous and cancerous cells and tissues. A "cancerous tumor," or "malignant cell" is understood as a cell having specific structural properties, lacking differentiation and being capable of invasion and metastasis. Cancers that can be treated using DDpp fusion proteins provided herein include hematological tumors, such as leukemias and lymphomas, or solid tumors. In particular embodiments, the cancer to be treated is a leukemia or a lymphoma. Types of cancers to be treated with the DBDpp include, but are not limited to, carcinoma, blastoma, and sarcoma, and certain leukemia or lymphoid malignancies, benign and malignant tumors, and malignancies e.g., sarcomas, carcinomas, and melanomas. Types of cancer and tumors that may be treated using DDpp-include without limitation, breast, lung, brain, bone, liver, kidney, colon, head and neck, ovarian, hematopoietic (e.g., leukemia), and prostate cancer. In some embodiments, the cancer and tumors that may be treated using DDpp-include breast and ovarian cancer. Other types of cancer and tumors that may be treated using DDpp-containing antibodies are described herein or otherwise known in the art.

The terms tumor antigen or cancer antigen are used interchangeably herein. Tumor and cancer antigens may be tumor-specific antigen (TSA), cancer-specific antigens (CSA) tumor-associated antigen (TAA) or cancer-associated antigens (CAA). A TSA is an antigen that is unique to tumor cells and does not occur on other cells in the body. A TAA is an antigen that is found on both tumor and some normal cells. Because of the dynamic nature of tumors, in some instances, tumor cells may express unique antigens at certain stages, and at others also express antigens that are also expressed on non-tumor cells. Thus, inclusion of a certain marker as a TAA does not preclude it being considered a TSA.

The term "target cell" as used herein refers to a cell or cells which are involved in a disease and can be targeted by DDpp containing compositions. Other target cells include any cell in a subject (e.g., a human or animal) that can be targeted by disclosed DDpp. The target cell can be a cell expressing or overexpressing a target specifically bound by a DDpp fusion protein.

The term "effector cells" as used herein refers to leukocytes which express one or more FcRs and perform effector functions. Preferably, the cells express at least Fc(RIII and perform ADCC effector function. Examples of human leukocytes which mediate ADCC include peripheral blood mononuclear cells (PBMC), natural killer (NK) cells, monocytes, cytotoxic T cells and neutrophils; with PBMCs and NK cells being preferred in certain embodiments. The effector cells can be isolated from native source thereof, e.g., from blood or PBMCs as described herein or otherwise known in the art. In a specific embodiment, the effector cells are human effector cells.

The term "effector function" refers to the specialized immune function of a differentiated cell. Effector function of a T cell, for example, may be cytolytic activity or helper activity including the secretion of cytokines.

The term "immune cell" as used herein refers to the cells of the mammalian immune system including but not limited to antigen presenting cells, B cells, basophils, cytotoxic T cells, dendritic cells, eosinophils, granulocytes, helper T cells, leukocytes, lymphocytes, macrophages, mast cells, memory cells, monocytes, natural killer cells, neutrophils, phagocytes, plasma cells and T cells.

The terms "T cell" and "T lymphocyte" are interchangeable and used synonymously herein. Examples include but are not limited to naive T cells, central memory T cells, effector memory T cells or combinations thereof.

The term "immune response" as used herein refers to immunities including but not limited to innate immunity, humoral immunity, cellular immunity, immunity, inflammatory response, acquired (adaptive) immunity, autoimmunity and/or overactive immunity.

The term "transduction" as used herein refers to the introduction of a foreign nucleic acid into a cell using a viral vector. "Transfection" as used herein refers to the introduction of a foreign nucleic acid into a cell using recombinant DNA technology. The term "transformation" means the introduction of a "foreign" (e.g., extrinsic, extracellular, or otherwise non-endogenous) nucleic acid (DNA or RNA) sequence to a host cell, so that the host cell will express the introduced nucleic acid to produce a desired substance, such as a protein or enzyme coded by the introduced coding sequence. The introduced nucleic acid sequence can also be called a "cloned" or "foreign" gene or sequence, can include regulatory or control sequences, such as start, stop, promoter, signal, secretion, or other sequences used by a cell's genetic machinery. The nucleic acid sequence can include nonfunctional sequences or sequences with no known function. A host cell that receives and expresses introduced nucleic acid (e.g., DNA or RNA) has been "transformed" and is a "transformant" or a "clone." The DNA or RNA introduced to a host cell can come from any source, including cells of the same genus or species as the host cell, or cells of a different genus or species or may be non-naturally occurring.

"Cell surface receptor" refers to molecules and complexes of molecules capable of receiving a signal and the transmission of such a signal across the plasma membrane of a cell. An example of a cell surface receptor provided herein is an activated integrin receptor, for example, an activated $\alpha v\beta 3$ integrin receptor on a metastatic cell. As used herein, "cell surface receptor" also includes a molecule expressed on a cell surface that contains a DDpp capable of binding a target of interest (e.g., BCMA, CD123, CS1, HER2, AFP, or AFP p26). The term "receptor" denotes a cell-associated protein that binds to, or otherwise interacts with, a molecule (e.g., a ligand) and mediates the effect of the ligand on the cell. In some embodiment, the molecule that interacts with a receptor is a bioactive molecule. Membrane-bound cell-surface receptors are typically characterized by a multi-domain structure comprising an extracellular ligand-binding domain, a membrane spanning domain, and an intracellular effector domain that is typically involved in signal transduction.

The term "CS1" as used herein refers to an NK cell receptor regulating immune functions that is also expressed on B cells, T cells, dendritic cells, NK-T cells, and monocytes. CS1 is overexpressed in multiple myeloma and has been successfully targeted for immunotherapy multiple myeloma. Malaer & Mathew, Am J Cancer Res. 7(8): 1637-1641 (2017). CS1 is also known as SLAM7, protein 19A, CRACC, and CD319. The term "CS1" includes variants, isoforms, homologues, orthologs and paralogs. CS1 is a transmembrane protein with various differentially spliced isoforms. In some embodiments, the amino acid sequence of human CS1, comprising a 22 amino acid residue N-terminal signal sequence (MAGSPTCLTLIYILWQLTGSAA, SEQ ID NO: 964) and an extracellular domain comprising the 226 N-terminal residues (SEQ ID NO: 965), has Genbank Accession No. NP_067004 (SEQ ID NO: 966). In some embodiments, the amino acid sequence of human CS1 has Genbank Accession No. NP_001269517, NP_001269518, NP_001269519, NP_001269520, NP_001269521, NP_001269522, NP_001269523, NP_001269524, or NP_001269525.

"Chimeric antigen receptor" or "CAR" or "CARs" as used herein refers to an engineered receptor, which grafts an antigen or target specificity onto a cell (for example T cells such as naive T cells, central memory T cells, effector memory T cells, NK cells, NKT cells or combination thereof). CARs are also known as artificial T cell receptors, chimeric T cell receptors or chimeric immunoreceptors.

D Domain Polypeptides (DDpp)

Unless otherwise indicated, the practice of the disclosed compositions and methods employs standard techniques of molecular biology (including recombinant techniques, tissue culture, and cell transformation), microbiology, cell biology, biochemistry and immunology, which are within the skill of the art. Such techniques are typically performed according to the manufacturer's specifications or as commonly accomplished using or routinely modifying known procedures such as, those set forth in Sambrook et al. (Molecular Cloning: A Laboratory Manual. Cold Spring Harbor Laboratory Press, Cold Spring Harbor, N.Y. (1989)); PCR Technology: Principles and Applications for DNA Amplification (ed. H. A. Erlich, Freeman Press, NY, N.Y., 1992); Oligonucleotide Synthesis (Gait, ed., 1984); Animal Cell Culture (Freshney, ed., 1987); Handbook of Experimental Immunology (Weir et al., eds.; Gene Transfer Vectors for Mammalian Cells (Miller, ed., 1987); Current Protocols in Molecular Biology (Ausubel., ed., 1987); PCR Protocols: A Guide to Methods and Applications (Innis, ed., Academic Press, San Diego, Calif., 1990); Mattila, et al., Nucleic Acids Res. 19: 967 (1991); Eckert, et al., PCR Methods and Applications 1: 17 (1991); PCR (McPherson, ed., IRL Press, Oxford); PCR: The Polymerase Chain Reaction, (Mullis, ed., 1994); Harlow, Antibodies: A Laboratory Manual, (Cold Spring Harbor Laboratory Press, 2nd ed. 1988) and Kontermann, ed., "The Antibody Engineering Lab Manual" (Springer Verlag, Heidelberg/New York, 2000); Current Protocols in Immunology (Coligan, ed., 1991); The Immunoassay Handbook (Wild, ed., Stockton Press NY, 1994); and Methods of Immunological Analysis (Masseyeff., ed., Weinheim: VCH Verlags gesellschaft mbH, 1993); and Gennaro, et al. 2000, Remington: the Science and Practice of Pharmacy, 20th Ed. Lipincott Williams and Wilkins: Baltimore, Md., or as described herein. Unless specific definitions are provided, the nomenclature utilized in connection with, and the laboratory procedures and techniques of analytical chemistry, synthetic organic chemistry, and medicinal and pharmaceutical chemistry described herein, are those known and used in the art. Additionally, standard techniques can be used for chemical syntheses, chemical analyses, recombinant production, purification, pharmaceutical preparation, formulation, delivery, and treatment of patients.

According to various embodiments, the disclosure provides a DDpp that specifically binds a target of interest selected from the group consisting of BCMA, CD123, CS1, HER2, AFP, and AFP p26. In some embodiments, a DD of the DDpp comprises an amino acid sequence selected from the group consisting of SEQ ID NO: 11-949, and 950. In some embodiments, the DDpp comprises a D Domain (DD) selected from the group consisting of: (a) a DD that specifically binds BCMA and comprises the amino acid sequence of SEQ ID NO: 11-305, or 306; (b) a DD that specifically binds CD123 and comprises the amino acid sequence of SEQ ID NO: 307-739, or 740; (c) a DD that specifically binds AFP or a fragment thereof, and comprises the amino acid sequence of SEQ ID NO: 741-874, or 886-895; (d) a DD that specifically binds AFP p26 and comprises the amino acid sequence of SEQ ID NO: 741-874, or 886-895, (e) a DD that specifically binds CS1 (SEQ ID NO: 965) or a fragment thereof, and comprises the amino acid sequence of SEQ ID NO: 896-909, or 910, (f) a DD that specifically binds HER2 or a fragment thereof, and comprises the amino acid sequence of SEQ ID NO: 911-949, or 950, Proteins comprising variants of (a)-(f) that retain the ability to specifically bind their respective targets are also provided.

In additional embodiments, a DD of the DDpp is a variant of a DD reference sequence selected from the group consisting of SEQ ID NO: 11-949, and 950, that retains the ability to specifically bind the target of the reference DD. In some embodiments, the sequence of the variant DD comprises the amino acid sequence of a variant that has at least 75%, 80%, 85%, 87%, 89%, 90%, 92%, 94%, 96% or 98% sequence identity to a reference DD sequence selected from the group consisting of SEQ ID NO: 11-949, and 950, and the variant DD retains the ability to specifically bind the target of the reference DD sequence.

In some embodiments, a DD of the DDpp is a variant of a BCMA-binding DD reference sequence selected from the group consisting of SEQ ID NO: 11-305, and 306, that retains the ability to specifically bind BCMA. In some embodiments, the sequence of the variant DD comprises the amino acid sequence of a variant that has at least 75%, 80%, 85%, 87%, 89%, 90%, 92%, 94%, 96% or 98% sequence identity to a reference DD sequence selected from the group consisting of SEQ ID NO: 11-305, and 306, and the variant DD retains the ability to specifically bind BCMA.

In some embodiments, a DD of the DDpp is a variant of a CD123-binding DD reference sequence selected from the group consisting of SEQ ID NO: 307-739, and 740, that retains the ability to specifically bind CD123. In some embodiments, the sequence of the variant DD comprises the amino acid sequence of a variant that has at least 75%, 80%, 85%, 87%, 89%, 90%, 92%, 94%, 96% or 98% sequence identity to a reference DD sequence selected from the group consisting of SEQ ID NO: 307-739, and 740, and the variant DD retains the ability to specifically bind CD123.

In some embodiments, a DD of the DDpp is a variant of a CS1-binding DD reference sequence selected from the group consisting of SEQ ID NO: 896-909, and 910, that retains the ability to specifically bind CS1. In some embodiments, the sequence of the variant DD comprises the amino acid sequence of a variant that has at least 75%, 80%, 85%, 87%, 89%, 90%, 92%, 94%, 96% or 98% sequence identity to a reference DD sequence selected from the group consisting of SEQ ID NO: 896-909, and 910, and the variant DD retains the ability to specifically bind CS1.

In some embodiments, a DD of the DDpp is a variant of a HER2-binding DD reference sequence selected from the group consisting of SEQ ID NO: 911-949, and 950, that retains the ability to specifically bind HER2. In some embodiments, the sequence of the variant DD comprises the amino acid sequence of a variant that has at least 75%, 80%, 85%, 87%, 89%, 90%, 92%, 94%, 96% or 98% sequence identity to a reference DD sequence selected from the group consisting of SEQ ID NO: 911-949, and 950, and the variant DD retains the ability to specifically bind HER2.

In some embodiments, a DD of the DDpp is a variant of a AFP-binding DD reference sequence selected from the group consisting of SEQ ID NO: 741-874, and 886-895, that retains the ability to specifically bind AFP. In some embodiments, the sequence of the variant DD comprises the amino acid sequence of a variant that has at least 75%, 80%, 85%, 87%, 89%, 90%, 92%, 94%, 96% or 98% sequence identity to a reference DD sequence selected from the group consisting of SEQ ID NO: 741-874, and 886-895, and the variant DD retains the ability to specifically bind AFP.

In some embodiments, a DD of the DDpp is a variant of a AFP p26-binding DD reference sequence selected from the group consisting of SEQ ID NO: 741-874, or 886-895, that retains the ability to specifically bind AFP p26. In some embodiments, the sequence of the variant DD comprises the amino acid sequence of a variant that has at least 75%, 80%, 85%, 87%, 89%, 90%, 92%, 94%, 96% or 98% sequence identity to a reference DD sequence selected from the group consisting of SEQ ID NO: 741-874, or 886-895, and the variant DD retains the ability to specifically bind AFP p26.

In particular embodiments, the identity between a variant DD (query) sequence and a reference DD sequence, also referred to as a global sequence alignment, is determined using the FASTDB computer program based on the algorithm of Brutlag et al. Comp. App. Biosci. 6: 237-245 (1990). Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter. According to this embodiment, if the reference DD sequence is shorter than the variant DD query sequence due to N- or C-terminal deletions, not because of internal deletions, a manual correction is made to the results to take into consideration the fact that the FASTDB program does not account for N- and C-terminal truncations of the reference DD sequence when calculating global percent identity. For reference sequences truncated at the N- and C-termini, relative to the query sequence, the percent identity is corrected by calculating the number of residues of the query sequence that are N- and C-terminal of the reference sequence, which are not matched/aligned with a corresponding subject residue, as a percent of the total bases of the query sequence. A determination of whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of this embodiment.

In some embodiments, the DDpp contains a variant DD containing an amino acid sequence that differs from a corresponding reference DD of SEQ ID NO: 11-949, or 950, in two or more categories of sequence modifications (i.e., substitutions, deletions, insertions, and additions), and the variant DD retains the ability to bind the target of the respective reference DD (e.g., BCMA, CD123, CS1, HER2, AFP, and AFP p26). For example, the sequence of the variant DD may include combinations of amino acid deletions, insertions and substitutions compared to the sequence of the reference DD. In some embodiments, the sequence of the variant DD contains 1, 2, 3, 4, 5, 6, 7, 8, 9, 10, or more than 10, amino acid substitutions compared to a reference DD sequence of SEQ ID NO: 11-949, or 950. In some embodiments, the sequence of the variant DD contains 1, 2, 3, 4, 5, 6, 7, 8, 9, 10, or more than 10, conservative amino acid substitutions compared to a reference DD sequence of SEQ ID NO: 11-949, or 950. In some embodiments, the sequence of the variant DD contains 1, 2, 3, 4, 5, 6, 7, 8, 9, 10, or more than 10, nonconservative amino acid substitutions compared to a reference DD sequence of SEQ ID NO: 11-949, or 950. In some embodiments, the sequence of the variant DD contains 1, 2, 3, 4, 5, 6, 7, 8, 9, 10, or more than 10, conservative and nonconservative amino acid substitutions compared to a reference DD sequence of SEQ ID NO: 11-949, or 950. In some embodiments, the sequence of the variant DD contains 1, 2, 3, 4, 5, 6, 7, 8, 9, 10, or more than 10, amino acid deletions compared to a reference DD sequence of SEQ ID NO: 11-949, or 950. In some embodiments, the sequence of the variant DD contains 1, 2, 3, 4, 5, 6, 7, 8, 9, 10, or more than 10, amino acid insertions in a reference DD sequence of SEQ ID NO: 11-949, or 950 and the variant DD retains the ability to bind the target of the reference DD. Additionally provided are DDpp comprising a variant DD in which amino acid residues have been deleted from the amino terminus, the carboxy terminus, or both the amino and carboxy termini of a corresponding reference DD of SEQ ID NO: 866, and 867 In some embodiments, the sequence of the variant DD contains a sequence with 1, 2, 3, 4, 5, 6, 7, 8, 9, 10, 11, or 12, amino acid residues deleted from the amino terminus of a reference DD sequence of SEQ ID NO: 11-949, or 950 and the variant DD retains the ability to bind the target of the reference DD. In some embodiments, the sequence of the variant DD contains a sequence with 1, 2, 3, 4, 5, 6, 7, 8, 9, 10, 11, or 12, amino acid residues deleted from the carboxy terminus of a reference DD of SEQ ID NO: 11-949, or 950 and the variant DD retains the ability to bind the target of the reference DD. In some embodiments, the sequence of the variant DD sequence contains 1-5, 1-10, or 1 to 15, amino acid residues deleted from the amino terminus of a reference DD sequence of SEQ ID NO: 11-949, or 950, the variant DD sequence has 1-5, 1-10, or 1 to 15, amino acid residues deleted from the carboxy terminus of the reference DD sequence, and the variant DD retains the ability to bind the target of the reference DD.

DDpp Fusion Proteins

A "fusion protein," "chimeric polypeptide," "chimeric protein," "chimeric antigen," and a DDpp that comprises/contains a heterologous polypeptide, is a polypeptide comprised of at least two polypeptides and optionally a linker to operatively link the two polypeptides into one continuous polypeptide produced, e.g., by recombinant processes. The two polypeptides may be operably attached directly or indirectly.

A "DDpp fusion protein" provided herein comprises at least one DDpp disclosed herein that specifically binds a target of interest (e.g., BCMA (SEQ ID NO: 7), CD123 (SEQ ID NO: 8), CS1 (SEQ ID NO: 965), HER2 (SEQ ID NO: 967), AFP (SEQ ID NO: 9), AFP p26 (SEQ ID NO: 10), or a fragment thereof). In one embodiment, the DDpp fusion protein contains one DDpp.

In some embodiments, the DDpp fusion protein is a soluble protein comprising one or more target-binding DDpp and a p26 protein (e.g., having the sequence of SEQ ID NO: 10, 968, 969, 970, 971, 972, 973, or 974). Such fusion proteins containing p26 sequences have been discovered herein to have surprisingly long serum half-life. In some embodiments, the soluble DDpp fusion protein has a plasma half-life in vivo of at least 1 hour, at least 2 hours, at least 4 hours, at least 8 hours, at least 16 hours, at least 32 hours, at least 64 hours, or more. In some embodiments, the soluble fusion protein has an in vivo plasma half-life of at least 1 hour, at least 2 hours, at least 4 hours, at least 8 hours, at least 16 hours, at least 32 hours, at least 64 hours, or more hours 65 hours, or 1-10 hours, 2-10 hours, 4-10 hours, 6-10 hours, or 6-9 hours in a mouse. In some embodiments, the soluble DDpp fusion protein has an in vivo plasma half-life of at least 1 hour, at least 2 hours, at least 4 hours, at least 8 hours, at least 16 hours, at least 32 hours, at least 64 hours, or more hours 65 hours, or 1-10 hours, 2-10 hours, 4-10 hours, 6-10 hours, or 6-9 hours, in a human.

In some embodiments, the disclosure provides a method for modifying the in vivo half-life (e.g., in a mouse or human) of a soluble fusion protein comprising a p26 protein (e.g., having the sequence of SEQ ID NO: 10, 968, 969, 970, 971, 972, 973, or 974). In some embodiments, the soluble p26 fusion protein comprises one or more target-binding DDpp. In some embodiments, the half-life of the p26 soluble fusion protein is increased or decreased by substituting or deleting one or more amino acid residues normally found in the human p26 protein, or by inserting one or more amino acid residues not normally found in the human p26 protein. In another embodiment, the p26 sequence of the soluble fusion protein is modified through 1, 2, 3, 5, 5, 10, or 1-20, 1-10, 3-10, or 3-5, amino acid substitutions (conservative and/or nonconservative substitutions), deletions, and/or insertions so as to increase or decrease the in vivo half-life of the soluble fusion protein. In a particular embodiment, the amino acid residue corresponding to the glutamine (Gln, Q) at position 217 of SEQ ID NO: 10 of p26 is substituted with another amino acid residues. In a further embodiment the substitution is Gln217Pro. In another embodiment, the p26 sequence of the soluble fusion protein is modified through deletion of 1-150, 1-100, 1-50, 1-25 or 1-10 amino acid residues so as to increase or decrease the in vivo half-life of the soluble fusion protein. In additional embodiments, the p26 sequence of the soluble fusion protein is modified through 1, 2, 3, 5, 5, 10 or 1-20, 1-10, 3-10, or 3-5, amino acid substitutions (conservative and/or nonconservative substitutions), deletions, and/or insertions so as to increase or decrease the interaction of the soluble fusion protein with FcRn.

Multimeric DDpp Fusion Proteins

In one embodiment, the DDpp fusion protein comprises more than one DDpp, wherein two or more DDpp have the same or different specificities. In additional embodiments, the DDpp fusion protein comprises a tandem repeat of the same or different DD that allow a DDpp fusion protein to bind multiple targets and/or repeating epitopes or different epitopes on the same target. In some embodiments, the DDpp fusion protein comprises at least 2, 3, 4, or 5, or more than 5, DDpp. In some embodiments, the DDpp fusion protein contains 1-3, 1-4, 1-5, or more than 5, different DDpp. In some embodiments, the DDpp fusion protein contains at least 2, 3, 4, or 5, or more than 5, different DDpp. Thus, a DDpp fusion protein can be a monomeric DDpp (i.e., containing one DDpp) or multimeric DDpp (i.e., containing more than one DDpp in tandem optionally operably connected by a linker). In some embodiments, the use of multimeric DDpp provides enhanced (e.g., synergistic) target binding. In additional embodiments, multimeric DDpp allows targeting of more than one target using a single DDpp construct (e.g., bi-, tri-specific, etc.). The linkage of two or more identical DDpp results in a multivalent molecule that provides distinct advantages (e.g., increased binding avidity, target clustering and receptor activation) over monovalent compositions. The linkage of two or more different DDpp results in a multivalent and multi-specific molecule that has the potential to bind more than one target antigen, either independently or simultaneously.

The multimeric DDpp fusion protein can be a DDpp homo-multimeric (i.e., containing more than one of the same DDpp in tandem optionally connected by linker(s) (e.g., homodimers, homotrimers, homotetramers etc.) or DDpp hetero-multimeric (i.e., containing two or more DDpp in which there are at least two different DDpp protein. The number of monomeric DDpp included within a multimeric composition may vary, depending on the embodiment, and may be defined, at least in part, by the expression system in which the DDpp is produced. In some embodiments, however, the fusion proteins may comprises multimers of about 5 to about 10 DDpp subunits, about 10 to about 15 subunits, about 15 to about 20 subunits, about 20 to about 25 subunits, or about 25 to about 30 subunits (including numbers in between those listed as well as endpoints). Moreover, multiple tandem components of a DDpp fusion protein can contain the same or different DDpp. In some DDpp fusions, the DDpp are present as a monomer, or in homomultimers or heteromers such as, homodimers or heterodimers, homotrimers or heterotrimers, homotetramers or heterotetramers.

A DDpp fusion protein can be "monospecific" or "multispecific." A DDpp fusion protein that is "multi-specific" (e.g., bispecific, trispecific or of greater multi-specificity)

recognizes and binds to two or more different epitopes present on one or more different molecules (e.g., proteins, solid support structures, etc.).

In some embodiments, two or more DDs are fused together as a multivalent DDpp. The DD of the multivalent DDpp may be the same or different. Thus, the disclosure provides a DDpp homo-dimer (i.e., a DDpp comprising two identical DD), a DDpp homo-multimer (i.e., a DDpp comprising three or more identical DD), a DDpp hetero-dimer (i.e., a DDpp comprising two different DD), and DDpp hetero-multimer (i.e., a DDpp comprising three or more DD, wherein at least two of the DD are different) comprising any of the DD described herein, optionally attached by one or more linkers.

In some embodiments, two or more DDs are linked by a multimerization domain or attached via chemical linkage, to generate a multivalent DD complex. The DD of the multivalent DD complex may be the same or different. Thus, the disclosure provides a DD homo-dimer complex (i.e., a DD complex comprising two identical DD), a DD homo-multimer complex (i.e., a DD complex comprising three or more identical DD), a DD hetero-dimer complex (i.e., a DD complex comprising two different DD), and DD hetero-multimer complex (i.e., a DD complex comprising three or more DD, wherein at least two of the DD are different) comprising any of the DD described herein, optionally attached by one or more linkers.

In one embodiment, a multi-specific DDpp fusion protein contains at least two DDpp that bind to at least two different epitopes on a single target of interest (e.g., BCMA, CD123, CS1, HER2, AFP, or AFP p26). In a further embodiment, the DDpp fusion is bispecific and specifically binds to two different targets expressed on the surface of two different cell types. In one embodiment the bispecific DDpp fusion protein specifically binds to a target on a cancer cell and a target on an immune effector cell. In one embodiment the bispecific DDpp fusion protein specifically binds a target expressed on a cancer cell (e.g., BCMA, CS1, CD123, and CD19) and a target expressed on the surface of a T lymphocyte (e.g., CD3). In one embodiment the bispecific DDpp fusion protein specifically binds BCMA and CS1.

In additional embodiments, a multi-specific DDpp fusion protein comprises at least one DDpp that specifically binds one epitope on a target of interest and at least one other domain or sequence conferring function (e.g., an antibody fragment or domain such as an scFv) that specifically binds to a different epitope on the same target of interest. In one embodiment, a multi-specific DDpp fusion protein comprises at least one DDpp that specifically binds to an epitope on a target of interest and at least one domain or sequence conferring function e.g., an antibody fragment or domain (e.g., scFv), that specifically binds to an epitope on a different target of interest. In one embodiment, the multi-specific DDpp fusion protein comprises at least one DDpp that specifically binds to an epitope on a target of interest and at least one domain or sequence that specifically binds to an epitope on a different target on the same cell. In other embodiments, a DDpp fusion protein comprises at least one DDpp and at least one other DDpp or domain sequence conferring function, e.g., an antibody fragment or domain that specifically binds to a solid support.

In a further embodiment, the multimeric DDpp fusion comprising 2 or more DDpp are in turn fused with other heterologous proteins (or their subdomains) and in so doing, impart the multivalent and multi-specific properties to the fusion partner. Examples of fusion partners of a DDpp include but are not limited to, antibodies, antibody subdomains (e.g., scFv or Fc domains), serum albumin, serum albumin subdomains, cell surface receptors, an alpha chain of a T cell receptor (TCR), a beta chain of a T cell receptor, cell surface receptor subdomains, peptides, peptide tags (e.g., FLAG or myc), fibronectin type III repeats, z-domains, elastin-like polypeptides. The number and location of DDpp and their respective positions within the fusion protein can vary. For example, DDpp(s) can be located at one or all termini of a fusion partner and/or interspersed within heterologous subunits within the DDpp fusion partner.

In additional embodiments, a DDpp fusion protein comprises a DDpp and a polypeptide sequence containing an additional domain. In some embodiments, the DDpp fusion protein comprises a DDpp and a member selected from: an antibody, an antibody fragment (e.g., an antigen binding domain or portion thereof (e.g., an scFv), an effector domain or portion thereof, an FcRn binding domain or portion thereof, and an Fc or a portion thereof), a serum protein (e.g., albumin or a portion thereof), a cytokine, a growth factor, a hormone, an imaging agent, a labeling agent, and a peptide tag. In some embodiments, the DDpp fusion protein comprises an Fc domain of an immunoglobulin (e.g., a human Fc domain) or a portion thereof. In further embodiments, the Fc domain is a variant human Fc domain.

In some embodiments, the DDpp is fused to a heterologous polypeptide. In some embodiments, the heterologous polypeptide comprises a full-length antibody or an antibody fragment. In some embodiments, the DD is fused to: the amino terminus of a full-length antibody heavy chain; the amino terminus of a full-length antibody light chain; the carboxyl terminus of a full-length antibody heavy chain; or the carboxyl terminus of a full-length antibody light chain. In other embodiments, the DD is fused to an antibody fragment which is an Fc. In additional embodiments, the heterologous polypeptide comprises a member selected from the group consisting of: (i) a transmembrane domain; (ii) a membrane associating domain; (iii) human serum albumin or a fragment thereof (iv) AFP or a fragment thereof; (v) AFP p26 or a fragment thereof; (vi) the extracellular domain of a receptor or a fragment thereof; and (vii) the extracellular domain of an intracellular receptor (e.g., a nuclear protein) or a fragment thereof. In some embodiments, the DDpp contains a heterologous polypeptide comprising the extracellular domain, or a fragment of an extracellular domain, of a cell surface receptor.

In some embodiments, the DDpp of a DDpp fusion protein is incorporated into a larger, multi-domain molecular complex (e.g., a monomeric or multimeric DDpp fusion protein) and in so doing, imparts the functional attributes of the incorporated DDpp to the resultant fusion protein. In some embodiments, the DDpp fusion protein comprises a DDpp and a polypeptide sequence from an antibody, an antibody fragment, a serum protein (e.g., human serum albumin) or serum protein fragment, or a cell surface receptor, an alpha chain of a T cell receptor (TCR), a beta chain of a T cell receptor, cytokine, growth factor, hormone, or enzyme, or fragment thereof. Incorporation of DD into multidomain and/or multifunctional complexes can routinely be achieved by way of recombinant fusion to another polypeptide, binding to another chemical moiety, and covalent chemical linkage to another polypeptide (or other desirable chemical compound) using techniques known in the art. DDpp fusion proteins can additionally contain other optional components such as linkers and other components described herein.

DDpp Fusion Proteins as CARs

In addition to the incorporation of DD into soluble multi-domain proteins, the present invention provides a means by which to create cell-associated DDpp, comprised of at least one DDpp designed to impart binding specificity a membrane bound fusion protein. DDpp-receptors may be expressed by any cell type.

In one embodiment, the DDpp-receptor fusion protein comprises a chimeric antigen receptor (CAR), or DDpp-CAR, that comprises: an extracellular targeting domain and a transmembrane domain. In another embodiment, the DDpp-CAR is composed of an extracellular targeting domain, a transmembrane domain, and a cytoplasmic domain wherein the cytoplasmic domain comprises the signaling domain. In a further embodiment the DDpp-CAR extracellular domain comprises one or more DDpp, in which each DDpp constitutes a specific binding domain with the same or different specificities. In some embodiments, the target-specific domain is directed to one (or more) of the cancer or tumor antigens disclosed herein, such as BCMA, CD123, CS1, HER2, AFP, and AFP p26, as non-limiting examples. In one embodiment, the intracellular domain (e.g., the cytoplasmic domain) of the DDpp-CAR comprises the intracellular domain of CD3 zeta chain. In another embodiment the intracellular signaling domain of the DDpp is comprised of part of the intracellular domain of CD3 zeta chain. In a further embodiment, the intracellular domain of the DDpp-CAR comprises the intracellular domain of CD3 zeta chain and a costimulatory signaling region. The costimulatory signaling region refers to a portion of the DDpp-CAR comprising all or part of the intracellular domain of a costimulatory molecule. Costimulatory molecules are cell surface molecules other than antigens receptors or their ligands that are required for an efficient response of lymphocytes to antigen. Costimulatory molecules and portions of these molecules that are able to confer costimulatory properties to an AR are known in the art and can routinely be incorporated into the DDpp-CAR. In addition, truncations or mutation to these intracellular signaling and costimulatory domains may be incorporated to further enhance or reduce receptor signaling. In preferred embodiments, a T cell is genetically modified to stably express a DDpp-CAR. In such embodiments, the cytoplasmic domain of the DDpp-CAR can be designed to comprise the CD28 and/or 41BB signaling domain by itself or be combined with any other desired cytoplasmic domain(s) useful in the context of the disclosed embodiments. In one embodiment, the cytoplasmic domain of the DDpp-CAR can be designed to further comprise the signaling domain of CD3-zeta. In one embodiment, the DDpp-CAR comprises an extracellular targeting domain, an extracellular protein linker with a transmembrane domain that passes through the cellular membrane (such as found in T cells or NK cells), and a cytoplasmic domain, optionally comprising multiple signaling modules. In some embodiments, the DDpp-CAR may also comprise an epitope tag. In some embodiments, the cytoplasmic domain of the DDpp-CAR can include but is not limited to CD3-zeta, 41BB and CD28 signaling modules and combinations thereof.

In additional embodiments, the disclosure provides a chimeric antigen receptor (CAR), wherein the CAR includes a targeting domain comprising a DDpp disclosed herein, a transmembrane domain, and an intracellular signaling domain. In some embodiments, the intracellular signaling domain is selected from the group consisting of a human CD3 zeta domain, 41BB domain, a CD28 domain and/or any combination thereof. Depending on the embodiment, the costimulatory signaling region can comprise, for example, the intracellular domain of a costimulatory molecule selected from the group consisting of CD27, CD28, 41BB, OX40, CD30, CD40, PD1, lymphocyte function-associated antigen-1 (LFA 1), CD2, CD7, LIGHT, NKG2C, B7H3, a ligand that specifically binds with CD83, and any combination thereof. In some embodiments, the targeting domain of the CAR comprises a plurality of binding domains (e.g., DDs, or one or more DD and a scFv) that includes an additional target-binding polypeptide. Nucleic acids encoding CARs that include the target-binding polypeptides as part (or all) of the targeting region are also provided.

The disclosure also provides cells comprising a nucleic acid sequence encoding a CAR, wherein the CAR comprises an antigen binding domain made up of, at least in part, a disclosed DDpp that binds a target of interest (e.g., BCMA, CD123, CS1, HER2, AFP, and AFP p26), a transmembrane domain, and a signaling domain. In some embodiments, the CAR binds specifically to a tumor antigen (and thus functions to deliver the cell expressing the CAR to the tumor. In some embodiments, the tumor antigen is associated with a hematologic malignancy. In some embodiments, the tumor antigen is BCMA. In some embodiments, the tumor antigen is CD123. In some embodiments, the tumor antigen is CS1. In additional embodiments, tumor antigen is associated with a solid tumor. In some embodiments, the tumor antigen is HER2. In some embodiments, both solid and hematologic tumors are targeted. In some embodiments, the cell expressing the CAR is a T cell, a natural killer (NK) cell or other immune cell type. In some embodiments, the cell expressing the CAR (whether T cell, NK cell or other cell type) exhibits an anti-tumor immunity when the polypeptide binds to its corresponding tumor antigen.

Extracellular Domain

Depending on the desired antigen to be targeted, the DDpp-CAR can be engineered to include an antigen binding DDpp that is specific to the desired antigen target. For example, if BCMA is the desired antigen that is to be targeted, one or more BCMA-binding DDpp can be incorporated into the target specific binding domain of the DDpp-CAR. Moreover, the DDpp-CAR can include more than one DDpp, imparting multispecificity or multivalency to the DDpp-CAR. In some embodiments, the DDpp-CAR comprises a BCMA-binding DDpp. In some embodiments, the DDpp-CAR comprises a CS1-binding DDpp. In some embodiments, the DDpp-CAR comprises a BCMA-binding DDpp and a CS1-binding DDpp.

The choice of DDpp incorporated into the extracellular domain of the DDpp receptor (e.g., DDpp-CAR) depends upon the identity of the cell or cells to be targeted. For example, a DDpp-CAR may specifically bind to cell surface proteins such as a receptor on the same cell or another cell. In other embodiments, DDpp-CAR specifically binds to a soluble molecule, such as an immunoglobulin. In other embodiments, the targets of interest bound by the DDpp-CAR include those associated with viral, bacterial and parasitic infections, diseases and disorders of the immune system (e.g., autoimmune disease).

In other embodiments, the DDpp-CAR may be chosen to recognize a ligand that acts as a cell surface marker on target cells associated with a cancer. A DDpp-CAR can in some embodiments, target and bind a tumor antigen (e.g., a TAA or other tumor antigen described herein or otherwise known in the art. Accordingly, provided herein are methods for creating DDpp-CAR, their use in creating chimeric cells such as, human T cells and natural killer cells and the use of these chimeric T cells in adoptive immunotherapy.

In the context provided herein, "tumor antigen" refers to antigens that are common to specific hyperproliferative disorders such as cancer. Tumor antigens that can be specifically bound by a DDpp in a DDpp-CAR are disclosed herein. In one embodiment, a DDpp in a DDpp-CAR specifically binds a tumor-specific antigen (TSA) or a tumor-associated antigen (TAA). A TSA is unique to tumor cells and does not occur on other cells in the body. A TAA associated antigen is not unique to a tumor cell and instead is also expressed on a normal cell under conditions that fail to induce a state of immunologic tolerance to the antigen. The expression of the antigen on the tumor may occur under conditions that enable the immune system to respond to the antigen. TAAs may be antigens that are expressed on normal cells during fetal development when the immune system is immature and unable to respond or they may be antigens that are normally present at extremely low levels on normal cells but which are expressed at much higher levels on tumor cells.

In some embodiments, a DDpp in the antigen binding moiety portion of a DDpp-CAR specifically binds BCMA, CS1, HER2, or CD123. In some embodiments, the DDpp specifically binds a BCMA protein having an amino acid sequence consisting of SEQ ID NO: 7. In further embodiments, the DDpp specifically binds BCMA and comprises an amino acid sequence selected from the group consisting of SEQ ID NO: 11-305, and 306. In some embodiments, the DDpp specifically binds a CD123 protein having an amino acid sequence consisting of SEQ ID NO: 8. In further embodiments, the DDpp specifically binds CD123 and comprises an amino acid sequence selected from the group consisting of SEQ ID NO: 307-739, and 740. In some embodiments, the DDpp specifically binds a CS1 protein having an amino acid sequence consisting of SEQ ID NO: 965. In further embodiments, the DDpp specifically binds CS1 and comprises an amino acid sequence selected from the group consisting of SEQ ID NO: 896-909, and 910. In some embodiments, the DDpp specifically binds a CS1 and BCMA. In some embodiments, the DDpp specifically binds a HER2 protein having an amino acid sequence consisting of SEQ ID NO: 967. In further embodiments, the DDpp specifically binds HER2 and comprises an amino acid sequence selected from the group consisting of SEQ ID NO: 911-949, and 950. In additional embodiments, the antigen binding moiety portion of the DDpp-CAR further binds a target selected from: HVEM, BTLA, DR3, CD19, CD20, and CD22.

In one embodiment, a DDpp in a DDpp-CAR specifically binds a tumor antigen associated with a malignant tumor. In one embodiment, a DDpp of a DDpp-CAR binds to an antigen selected from: a B cell lymphoma-specific idiotype immunoglobulin; a B cell differentiation antigen such as CD19, CD20 and CD37; TSLPR and IL7R on myeloid cells, and heat shock protein gp96 on multiple myeloma cells.

In some embodiments, a DDpp in the antigen binding moiety portion of a DDpp-CAR specifically binds AFP, AFP p26, or a fragment thereof. In some embodiments, the DDpp specifically binds an AFP protein having an amino acid sequence consisting of SEQ ID NO: 9, or a fragment thereof. In some embodiments, the DDpp specifically binds an AFP p26 protein having an amino acid sequence consisting of SEQ ID NO: 10, or a fragment thereof. In further embodiments, the DDpp specifically comprises an amino acid sequence selected from the group consisting of SEQ ID NO: 741-874, and 886-895. In some embodiments, the antigen binding moiety portion of the DDpp-CAR further binds a tumor antigen. In additional embodiments, the antigen binding moiety portion of the DDpp-CAR further binds a target selected from: BCMA, CD123, CS1, HER2, HVEM, BTLA, DR3, CD19, CD20, and CD22.

Transmembrane Domain

"Transmembrane domain" (TMD) as used herein refers to the region of a cell surface expressed DDpp fusion protein such as a DDpp-CAR, which crosses the plasma membrane. In some embodiments, the transmembrane domain of the DDpp-CAR is the transmembrane region of a transmembrane protein (for example Type I transmembrane proteins), an artificial hydrophobic sequence or a combination thereof. Other transmembrane domains will be apparent to those of skill in the art and may be used in connection with alternate embodiments provided herein.

The DDpp receptor (e.g., DDpp-CAR) can be designed to contain a transmembrane domain that is fused to the extracellular domain of the DDpp receptor. As described above, the fusion of the extracellular and transmembrane domains can be accomplished with or without a linker. In one embodiment, the transmembrane domain that is naturally associated with one of the domains in the DDpp-CAR is used. In a specific embodiment, the transmembrane domain in the DDpp-CAR is the CD8 transmembrane domain. In some instances, the transmembrane domain of the DDpp-CAR comprises the CD8 hinge domain. In some embodiments, the transmembrane domain is be selected or modified by amino acid substitution to promote or inhibit association with other surface membrane proteins.

The transmembrane domain can be derived either from a natural or from a synthetic source. Where the source is natural, the domain can be derived from any membrane-bound or transmembrane protein. Transmembrane regions of particular use for the purposes herein may be derived from (i.e., comprise at least the transmembrane region(s) of) a member selected from the group: the alpha, beta or zeta chain of the T cell receptor; CD28, CD3 epsilon, CD45, CD4, CD5, CD8, CD9, CD16, CD22, CD33, CD37, CD64, CD80, CD86, CD134, CD137, and CD154. Alternatively the transmembrane domain can be synthetic, in which case the DDpp-CAR transmembrane domain will comprise predominantly hydrophobic residues such as leucine and valine. In further embodiments, the transmembrane domain comprises the triplet of phenylalanine, tryptophan and valine at each end of a synthetic transmembrane domain.

"Extracellular spacer domain" (ESD) as used herein refers to the hydrophilic region which is between the antigen-specific targeting region and the transmembrane domain. In some embodiments, the DDpp-CAR comprise an extracellular spacer domain. In other embodiments, the DDpp-CAR does not comprise an extracellular spacer domain. The extracellular spacer domains include but are not limited to Fc fragments of antibodies or fragments or derivatives thereof, hinge regions of antibodies or fragments or derivatives thereof, CH2 regions of antibodies, CH3 regions of antibodies, artificial spacer sequences or combinations thereof. Additional examples of extracellular spacer domains include but are not limited to CD8a hinge, and artificial spacers made of polypeptides which may be as small as, for example, Gly3 or CHI and CH3 domains of IgGs (such as human IgG4). In some embodiments, the extracellular spacer domain is any one or more of (i) a hinge, CH2 and CH3 regions of IgG4, (ii) a hinge region of IgG4, (iii) a hinge and CH2 of IgG4, (iv) a hinge region of CD8a, (v) a hinge, CH2 and CH3 regions of IgG1, (vi) a hinge region of IgG1 or (vi) a hinge and CH2 region of IgG1. Other extracellular spacer domains will be apparent to those of skill in the art and may be used in connection with alternate embodiments, provided herein.

In some embodiments, a short oligo- or polypeptide linker, from about 1 to 100 amino acids in length, is used to link together any of the domains of a DDpp-CAR. Linkers can be composed of flexible residues like glycine and serine (or any other amino acid) so that the adjacent protein domains are free to move relative to one another. The amino acids sequence composition of the linker may be selected to minimize potential immunogenicity of the DDpp-CAR or DDpp fusion protein. Longer linkers can be used when it is desirable to ensure that two adjacent domains do not sterically interfere with one another. In some embodiments, preferably between 2 and 10 amino acids in length forms the linkage between the transmembrane domain and the cytoplasmic signaling domain of the DDpp-CAR. In further embodiments, the linker is between 10 and 15 amino acids in length, or between 15 and 20, or between 20 and 30, or between 30 and 60, or between 60 and 100 amino acids in length (or any range in between those listed). In further embodiments, the linker is a glycine-serine doublet sequence. Further embodiments employ a fragment of the hinge region derived from the human T cell surface glycoprotein CD8 alpha-chain (for example ranging from amino acid positions 138-182 CD8 alpha chain; Swiss-Prot accession number P01732). Further embodiments employ a fragment of the CD8 hinge region that has been further modified, through amino acid substitution, to improve expression function or immunogenicity. Further embodiments employ a fragment of the extracellular region derived from the human CD28 Further embodiments employ a fragment of the CD28 extracellular region that has been further modified, through amino acid substitution, to improve expression function or immunogenicity.

Intracellular Domain

"Intracellular signaling domain" (ISD) or "cytoplasmic domain" as used herein refer to the portion of the DDpp-CAR which transduces the effector function signal and directs the cell to perform its specialized function. The cytoplasmic domain (i.e., intracellular signaling domain) of a DDpp-CAR is responsible for activation of at least one of the normal effector functions of an immune cell engineered to express a DDpp-CAR. The term "effector function" refers to a specialized function of a cell. The effector function of a T cell, for example, includes cytolytic activity and helper activity including the secretion of cytokines. Thus the term "intracellular signaling domain" refers to the portion of a DDpp-CAR protein which transduces the effector function signal and directs the cell to perform a specialized function. While typically the entire intracellular signaling domain corresponding to a naturally occurring receptor can be employed, in many cases it is not necessary to use the entire chain. To the extent that a truncated portion of the intracellular signaling domain is used, such truncated portion can be used in place of the intact chain as long as it transduces the effector function signal. The term intracellular signaling domain is thus meant to include any truncated portion of the intracellular signaling domain sufficient to transduce the effector function signal. In one embodiment, an intracellular signaling domain in the DDpp-CAR includes the cytoplasmic sequences of the T cell receptor (TCR) and also the sequence of co-receptors that act in concert to initiate signal transduction following antigen receptor engagement, or any derivative or variant of these sequences that has functional capability. Examples of domains that transduce an effector function signal include but are not limited to the ζ chain of the T cell receptor complex or any of its homologs (e.g., η chain, FcεR1γ and β chains, MB 1 (Igα) chain, B29 (Ig) chain, etc.), human CD3 zeta chain, CD3 polypeptides (Δ, δ and ε), syk family tyrosine kinases (Syk, ZAP 70, etc.), src family tyrosine kinases (Lck, Fyn, Lyn, etc.) and other molecules involved in T cell transduction, such as CD2, CD5 and CD28.

It is known that signals generated through the TCR alone are insufficient for full activation of the T cell and that a secondary or co-stimulatory signal is also required. Thus, T cell activation can be said to be mediated by two distinct classes of cytoplasmic signaling sequence: those that initiate antigen-dependent primary activation through the TCR (primary cytoplasmic signaling sequences) and those that act in an antigen-independent manner to provide a secondary or co-stimulatory signal (secondary cytoplasmic signaling sequences).

Primary cytoplasmic signaling sequences regulate primary activation of the TCR complex either in a stimulatory way, or in an inhibitory way. Primary cytoplasmic signaling sequences that act in a stimulatory manner may contain signaling motifs which are known as immunoreceptor tyrosine-based activation motifs (ITAMs).

Examples of ITAM containing primary cytoplasmic signaling sequences that are of particular use in the provided embodiments include those derived from TCR zeta, FcR gamma, FcR beta, CD3 gamma, CD3 delta, CD3 epsilon, CD22, CD79a, CD79b, and CD66d. It is particularly preferred that cytoplasmic signaling molecule in the CAR comprises a cytoplasmic signaling sequence derived from CD3 zeta.

"Co-stimulatory domain" (CSD) as used herein refers to the portion of a CAR or DDpp-CAR which enhances the proliferation, survival and/or development of memory cells. The DDpp-CAR may comprise one or more co-stimulatory domains. Each co-stimulatory domain comprises the costimulatory domain of any one or more of, for example, a member of the TNFR superfamily, selected from CD28, CD137 (4-1BB), CD134 (OX40), Dap10, CD27, CD2, CD5, ICAM-1, LFA-1(CD1 la/CD18), Lck, TNFR-I, TNFR-II, Fas, CD30, and CD40 or a combination thereof. Other co-stimulatory domains (e.g., from other proteins) will be apparent to those of skill in the art and may be used in connection with alternate embodiments encompassed by the disclosure.

In a preferred embodiment, the cytoplasmic domain of a DDpp-CAR comprises the CD3-zeta signaling domain by itself or combined with any other desired cytoplasmic domain(s) useful in the context of the DDpp-CAR. For example, the cytoplasmic domain of the DDpp-CAR can comprise a CD3 zeta chain portion and a costimulatory signaling region. The costimulatory signaling region refers to a portion of the CAR comprising the intracellular domain of a costimulatory molecule. A costimulatory molecule is a cell surface molecule other than an antigen receptor or their ligands that is required for an efficient response of lymphocytes to an antigen. Examples of such molecules include CD27, CD28, 41BB (CD 137), OX40, CD30, CD40, PD1, ICOS, lymphocyte function-associated antigen-1 (LFA1), CD2, CD7, LIGHT, NKG2C, B7H3, TIM1, and LAG3.

Polypeptide linkers may be positioned between adjacent elements of the DDpp-CAR. For example linkers may be positioned between adjacent DDpp or between DDpp and the transmembrane domain or between the transmembrane domain and the cytoplasmic domain or between adjacent cytoplasmic domains. The cytoplasmic signaling sequences within the cytoplasmic signaling portion of the DDpp-CAR may be linked to each other in a random or specified order.

Optionally, a short linker, preferably between 2 and 10 amino acids in length may form the linkage. A glycine-serine doublet provides a particularly suitable linker.

In additional embodiments, the DDpp fusion protein is a chimeric antigen receptor (CAR) which comprises a target binding domain comprising a DD disclosed herein (e.g., a DD comprising the amino acid sequence of SEQ ID NO: 11-949, or 950). In some embodiments, the DD binds BCMA and comprises an amino acid sequence selected from the group consisting of SEQ ID NO: 11-305, and 306. In some embodiments, the DD binds CD123 and comprises an amino acid sequence selected from the group consisting of SEQ ID NO: 307-739, and 740. In some embodiments, the DD binds CS1 and comprises an amino acid sequence selected from the group consisting of SEQ ID NO: 896-909, and 910. In some embodiments, the DD binds HER2 and comprises an amino acid sequence selected from the group consisting of SEQ ID NO: 911-949, and 950. In some embodiments, the DD binds AFP and comprises an amino acid sequence selected from the group consisting of SEQ ID NO: 741-874, and 886-895. In some embodiments, the DD binds AFP p26 and comprises an amino acid sequence selected from the group consisting of SEQ ID NO: 741-874, and 886-895. In some embodiments, the CAR comprises, a target binding, domain, a transmembrane domain, and an intracellular signaling domain. In some embodiments, the CAR transmembrane domain comprises a 41BB or CD28 transmembrane domain. In some embodiments the CAR comprises an intracellular signaling domain selected from the group consisting of a domain of a human T cell receptor alpha, beta, or zeta chain; a human 41BB domain; a human CD28 domain; and any combination thereof. In some embodiments, the CAR intracellular signaling domain comprises the intracellular domain of a costimulatory molecule selected from the group consisting of CD27, CD28, 41BB, OX40, CD30, CD40, PD1, lymphocyte function-associated antigen-1 (LFA-1), CD2, CD7, LIGHT, NKG2C, B7-H3, a ligand that specifically binds with CD83, and any combination thereof. In some embodiments the CAR further comprises a second target binding domain having the same or a different target than the DD target binding domain. In some embodiments, the CAR comprises a first target binding domain that binds CS1 and a second target binding domain that binds BCMA. In some embodiments, the CAR is expressed in an immune cell. In some embodiments, the immune cell is a T Cell (CAR-T cell) or a natural killer (NK) cell (CAR-NK cell). In some embodiments, the CAR is associated with a liposome. In some embodiments, the CAR comprises 2, 3, 4, 5, or more than 5, DD and/or other binding domains (e.g., scFv) that specifically bind a target of interest (e.g., BCMA, CS1, or CD123) expressed on the surface of the cancer cell. In additional embodiments, the CAR comprises 2, 3, 4, 5, or more than 5, DD or other binding domains (e.g., scFv) that specifically bind a second, different target of interest, expressed on the surface of the cancer cell. In additional embodiments, the administered CAR further comprises 2, 3, 4, 5, or more than 5, DD or other binding domains (e.g., scFv) that specifically binds a second, different target of interest, expressed by a second, different cancer cell or a vascular endothelial cell.

Additional DDpp Fusion Proteins

In some embodiments, the DDpp contains a heterologous polypeptide comprising a fragment consisting of 5-500, 5-400, 5-300, 5-200, 5-100, 5-50, 10-500, 10-400, 10-300, 10-200, 10-100, or 10-50 amino acids of an extracellular domain, of a cell surface receptor. In some embodiments, the DDpp contains a heterologous polypeptide that comprises the extracellular domain, or a fragment of an extracellular domain of BCMA (SEQ ID NO: 7) or CD123 (SEQ ID NO: 8). In some embodiments, the DDpp contains a heterologous polypeptide that comprises the extracellular domain, or a fragment of an extracellular domain of BCMA (SEQ ID NO: 7), or CD123 (SEQ ID NO: 8), or CS1 (SEQ ID NO: 965). In some embodiments, the DDpp contains a heterologous polypeptide that comprises the extracellular domain, or a fragment of an extracellular domain, of a receptor selected from the group consisting of: CD19, CD20, CD22, HVEM, BTLA, DR3, CD37; TSLPR, IL7R, and gp96.

In some embodiments, the protein contains a heterologous polypeptide that comprises a serum protein or an antigenic fragment of a serum protein (e.g., AFP, and AFP p26). In some embodiments, the DDpp contains a heterologous polypeptide comprising a fragment consisting of 5-500, 5-400, 5-300, 5-200, 5-100, 5-50, 10-500, 10-400, 10-300, 10-200, 10-100, or 10-50 amino acids of a serum protein. In some embodiments, the protein contains a heterologous polypeptide that comprises an intracellular protein or an antigenic portion of an intracellular protein (e.g., a nuclear protein). In some embodiments, the DDpp contains a heterologous polypeptide comprising a fragment consisting of 5-500, 5-400, 5-300, 5-200, 5-100, 5-50, 10-500, 10-400, 10-300, 10-200, 10-100, or 10-50 amino acids of an intracellular protein. In some embodiments, the DDpp contains a heterologous polypeptide having the sequence of SEQ ID NO: 10, 968, 969, 970, 971, 972, 973, or 974.

In some embodiments, the DDpp fusion protein specifically binds BCMA, CD123, CS1, HER2, AFP, and/or AFP p26, and further binds one or more additional targets of interest. The targets of interest specifically bound by a DDpp fusion protein can be any molecule for which it is desirable for a DDpp to bind. For example, the targets specifically bound by the DDpp fusion protein can be BCMA, CD123, CS1, HER2, AFP, and/or AFP p26, and additionally any additional target of manufacturing, formulation, therapeutic, diagnostic, or prognostic relevance or value. A number of exemplary additional targets are provided herein, by way of example, and are intended to be illustrative and not limiting. The additional target of interest bound by the DDpp fusion protein can be naturally occurring or synthetic. The additional target of interest can be an extracellular component or an intracellular component, a soluble factor (e.g., an enzyme, hormone, cytokine, and growth factor, toxin, venom, pollutant, etc.), or a transmembrane protein (e.g., a cell surface receptor). In some embodiments, the target of interest bound by the DDpp fusion protein is a human protein. In one embodiment, a DDpp (e.g., a DDpp fusion protein) binds a human protein target of interest and its monkey (e.g., cynomolgous monkey), mouse, rabbit, hamster and/or a rabbit ortholog.

In one embodiment a DDpp fusion protein specifically binds BCMA, CD123, CS1, HER2, AFP, and/or AFP p26, and a serum protein. In one embodiment, the DDpp fusion protein specifically binds a serum protein selected from: serum albumin (e.g., human serum albumin (HSA)), thyroxin-binding protein, transferrin, fibrinogen, and an immunoglobulin (e.g., IgG, IgE and IgM). Without being bound by theory, the binding of a DDpp to a carrier protein is believed to confer upon the DDpp (or a fusion thereof) an improved pharmacodynamic profile that includes, but is not limited to, improved tumor targeting, tumor penetration, diffusion within the tumor, and enhanced therapeutic activity compared to the DDpp fusion protein in which the carrier protein binding sequence is missing (see, e.g., WO01/45746, the contents of which is herein incorporated by reference in its entirety).

Antibody-based DDpp Fusion Proteins

In some embodiments, the DDpp fusion protein comprises a full-length antibody or a fragment or subdomain of an antibody. In some embodiment, the DDpp fusion protein comprises a full length IgG antibody (e.g., IgG1, IgG2, IgG2, or IgG4). In further embodiments, the DDpp fusion protein comprises a full length antibody that specifically binds a cancer antigen. In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the DDpp is an Fc fusion protein. In further embodiments, the Fc protein comprises a variant human Fc domain.

In some embodiments, the DDpp fusion protein comprises a full-length antibody or an antibody fragment or subdomain (e.g., an IgG1 antibody, IgG3 antibody, antibody variable region, CDR3, scFv, Fc, FcRn binding subdomain, and other antibody subdomains). DDpp proteins can be operably linked to one another and/or to one or more termini of an antibody, antibody chain, antibody fragment, or antibody subdomain to form a DDpp fusion protein.

The antibody component of a DDpp fusion protein can be any suitable full-length immunoglobulin or antibody fragment (e.g., an antigen binding domain and/or effector domain) or a fragment thereof. In one embodiment, the DDpp-antibody fusion protein retains the structural and functional properties of a traditional monoclonal antibody. Thus, in some embodiments, the DDpp-antibody fusion protein retains the epitope binding properties, but advantageously also incorporate, via the DDpp fusion, one or more additional target-binding specificities. Antibodies that can be used in the DDpp fusions include, but are not limited to, monoclonal, multi-specific, human, humanized, primatized, and chimeric antibodies Immunoglobulin or antibody molecules provided herein can be of any type (e.g., IgG, IgE, IgM, IgD, IgA, and IgY), class (e.g., IgG1, IgG2, IgG3, IgG4, IgA1 and IgA2) or subclass of immunoglobulin molecule. In specific embodiments, the antibodies are Fc optimized antibodies. Antibodies can be from or derived from any animal origin including birds and mammals or generated synthetically. The antibody component of the DDpp-antibody fusion protein can be naturally derived or the result of recombinant engineering (e.g., phage display, xenomouse, and synthetic). In certain embodiments, the antibody component of the antibody-DDpp fusion enhances half-life, and increase or decrease antibody dependent cellular cytotoxicity (ADCC), and/or complement dependent cytotoxicity (CDC) activity. In some embodiments, the antibodies are human, murine, donkey, rabbit, goat, guinea pig, camel, llama, horse, or chicken antibodies. In specific embodiments, the antibodies are human.

It is generally understood that the constant region mediates several effector functions. For example, binding of the C1 component of complement to antibodies activates the complement system. Activation of complement is important in the opsonization and lysis of cell pathogens. The activation of complement also stimulates the inflammatory response and can also be involved in autoimmune hypersensitivity. Further, antibodies bind to cells via the Fc region, with an Fc receptor site on the antibody Fc region binding to an Fc receptor (FcR) on a cell. There are a number of Fc receptors that are specific for different classes of antibody, including IgG (gamma receptors), IgE (eta receptors), IgA (alpha receptors) and IgM (mu receptors). Binding of antibody to Fc receptors on cell surfaces triggers a number of important and diverse biological responses including engulfment and destruction of antibody-coated particles, clearance of immune complexes, lysis of antibody-coated target cells by killer cells (called antibody-dependent cell-mediated cytotoxicity, or ADCC), release of inflammatory mediators, placental transfer and control of immunoglobulin production.

In certain embodiments, the DDpp-Fc fusion protein has an altered effector function that, in turn, affects the biological profile of the administered DDpp-Fc fusion protein. For example, the deletion or inactivation (through point mutations or other means) of a constant region subdomain can reduce Fc receptor binding of the circulating modified antibody. In other cases the constant region modifications, can moderate complement binding and thus reduce the serum half-life and nonspecific association of a conjugated cytotoxin. Yet other modifications of the constant region can be used to eliminate disulfide linkages or oligosaccharide moieties that allow for enhanced localization due to increased antigen specificity or antibody flexibility. Similarly, modifications to the constant region in accordance with this disclosure can easily be made using biochemical or molecular engineering techniques known to those of ordinary skill in the art.

In some embodiments, the DDpp-Fc fusion protein does not have one or more effector functions. For instance, in some embodiments, the DDpp-Fc fusion protein has no antibody-dependent cellular cytoxicity (ADCC) activity and/or no complement-dependent cytoxicity (CDC) activity. In certain embodiments, the DDpp-Fc fusion protein does not bind to an Fc receptor and/or complement factors. In certain embodiments, the DDpp-Fc fusion protein has no effector function. Examples of Fc sequence engineering modifications that reduce or eliminate ADCC and/or CDC activity and Fc receptor and/or complement factor binding are described herein or otherwise know in the art, as are assays and procedures for testing the same.

In some embodiments, DDpp-Fc fusion protein is engineered to fuse the CH3 domain directly to the hinge region of the respective modified antibody. In other constructs a peptide spacer is inserted between the hinge region and the modified CH2 and/or CH3 domains. For example, compatible constructs can be expressed in which the CH2 domain has been deleted and the remaining CH3 domain (modified or unmodified) is joined to the hinge region with a 5-20 amino acid spacer. Such a spacer can be added, for instance, to ensure that the regulatory elements of the constant domain remain free and accessible or that the hinge region remains flexible Amino acid spacers can, in some cases, prove to be immunogenic and elicit an unwanted immune response against the construct. Accordingly, in certain embodiments, any spacer added to the construct can be relatively non-immunogenic, or even omitted altogether, so as to maintain the desired biochemical qualities of the modified DDpp-Fc fusion protein.

In additional embodiments, the DDpp-Fc fusion protein is modified by the partial deletion or substitution of a few or even a single amino acid in a constant region. For example, the mutation of a single amino acid in selected areas of the CH2 domain can be enough to substantially reduce Fc binding and thereby. Similarly one or more constant region domains that control the effector function (e.g., complement C1Q binding) can be fully or partially deleted. Such partial deletions of the constant regions can improve selected characteristics of the DDpp-Fc fusion protein (e.g., serum half-life) while leaving other desirable functions associated with the corresponding constant region domain intact. In some embodiments, the constant region of the DDpp-Fc fusion protein is modified through the mutation or substitution of one or more amino acids that enhances the profile of the resulting construct. In this respect it is possible to disrupt the activity provided by a conserved binding site (e.g., Fc binding) while substantially maintaining the configuration and immunogenic profile of the modified DDpp-Fc fusion protein. The disclosure also provides an DDpp-Fc fusion protein that contains the addition of one or more amino acids to the constant region to enhance desirable characteristics such, as decreasing or increasing effector function or providing attachments sites for one or more cytotoxin, labeling or carbohydrate moieties. In such embodiments, it can be desirable to insert or replicate specific sequences derived from selected constant region domains.

In some embodiments, the DDpp is operably linked to an antibody fragment or subdomain (e.g., scFv, diabody, EP 404,097; WO93/111161; WO14/028776; and Holliger et al., PNAS 90: 6444-6448 (1993), the contents of each of which is herein incorporated by reference in its entirety). The antibody fragment or subdomain can be any fragment or domain of an antibody. See for example, WO04/058820, WO99/42077 and WO05/017148, the contents of each of which is herein incorporated by reference in its entirety. For example, a DDpp fusion protein can contain an antibody effector domain or derivative of an antibody effector domain that confers one or more effector functions to the DDpp and/or confers upon the DDpp fusion protein the ability to bind to one or more Fc receptors. In some embodiments, a DDpp-antibody fusion protein contains an antigen-binding fragment of an antibody or a fragment thereof. In additional embodiments, a DDpp-antibody fusion protein contains an immunoglobulin effector domain that comprises one or more CH2 and or CH3 domains of an antibody having effector function provided by the CH2 and CH3 domains. Other sequences in the DDpp fusion that provide an effector function and that are encompassed by the invention will be clear to those skilled in the art and can routinely be chosen and designed into a DDpp fusion protein encompassed herein on the basis of the desired effector function(s).

In one embodiment, the DDpp fusion contains a full-length antibody or an antibody fragment that is an antigen-binding fragment. In a further embodiment, the antibody or antibody fragment binds a disease-related antigen. In one embodiment the DDpp fusion protein comprises an antibody or an antibody fragment that specifically binds a cancer antigen. In another embodiment, the DDpp fusion protein comprises an antibody or an antibody fragment that specifically binds a particular pathogen (e.g., a bacterial cell (e.g., tuberculosis, smallpox, anthrax)), a virus (e.g., HIV), a parasite (e.g., malaria, leishmaniosis), a fungal infection, a mold, a mycoplasm, a prion antigen, In another embodiment, the DDpp fusion protein comprises an antibody or an antibody fragment that specifically binds a particular pathogen (e.g., a bacterial cell (e.g., tuberculosis, smallpox, anthrax)), a virus (e.g., HIV), a parasite (e.g., malaria, leishmaniosis), a fungal infection, a mold, a mycoplasm, or a prion antigen. In another embodiment, the DDpp fusion protein comprises an antibody or an antibody fragment that specifically binds an antigen associated with a disease or disorder of the immune system.

In preferred embodiments, the DDpp fusion protein containing an antibody fragment or domain retains activities of the parent antibody. Thus, in certain embodiments, the DDpp fusion protein containing an antibody fragment or domain is capable of inducing complement dependent cytotoxicity. In certain embodiments, the DDpp fusion protein containing an antibody fragment or domain is capable of inducing antibody dependent cell mediated cytotoxicity (ADCC).

Accordingly, in some embodiments, the DDpp fusion protein comprises an antibody fragment that confers upon the DDpp fusion protein a biological or biochemical characteristic of an immunoglobulin. In some embodiments, the antibody fragment confers a characteristic selected from: the ability to non-covalently dimerize, the ability to localize at the site of a tumor, and an increased serum half-life when compared to the DDpp fusion protein in which said one or more DDpp have been deleted. In certain embodiments, the DDpp fusion protein is at least as stable as the corresponding antibody without the attached DDpp. In certain embodiments, the DDpp fusion protein is more stable than the corresponding antibody without the attached DDpp. DDpp fusion protein stability can be measured using established methods, including, for example, ELISA techniques. In some embodiments, the DDpp fusion protein is stable in whole blood (in vivo or ex vivo) at 37° C. for at least about 10 hours, at least about 15 hours, at least about 20 hours, at least about 24 hours, at least about 25 hours, at least about 30 hours, at least about 35 hours, at least about 40 hours, at least about 45 hours, at least about 48 hours, at least about 50 hours, at least about 55 hours, at least about 60 hours, at least about 65 hours, at least about 70 hours, at least about 72 hours, at least about 75 hours, at least about 80 hours, at least about 85 hours, at least about 90 hours, at least about 95 hours, or at least about 100 hours (including any time between those listed). In one embodiment, a DDpp fusion contains an immunoglobulin effector domain or half-life influencing domain that corresponds to an immunoglobulin domain or fragment in which at least a fraction of one or more of the constant region domains has been altered so as to provide desired biochemical characteristics such as reduced or increased effector functions, the ability to non-covalently dimerize, increased ability to localize at the site of a tumor, reduced serum half-life, or increased serum half-life when compared with an immunoglobulin fragment having the corresponding unaltered immunoglobulin sequence. These alterations of the constant region domains can be amino acid substitutions, insertions, or deletions.

In one embodiment, a DDpp fusion protein comprises an amino acid sequence of an immunoglobulin effector domain or a derivative of an immunoglobulin effector domain that confers antibody dependent cellular cytotoxicity (ADCC) to the DDpp fusion protein. In additional embodiments, a DDpp fusion protein comprises a sequence of an immunoglobulin effector domain that has been modified to increase ADCC (see, e.g., Bruhns, Blood 113: 3716-3725 (2009); Shields, J. Biol. Chem. 276: 6591-6604 (2001); Lazar, PNAS 103: 4005-4010 (2006); Stavenhagen, Cancer Res. 67: 8882-8890 (2007); Horton, Cancer Res. 68: 8049-8057 (2008); Zalevsky, Blood 113: 3735-3743 (2009); Bruckheimer, Neoplasia 11: 509-517 (2009); WO06/020114; Strohl, Curr. Op. Biotechnol. 20: 685-691 (2009); and WO04/074455; the contents of each of which is herein incorporated by reference in its entirety). Examples of immunoglobulin fragment engineering modifications contained in an amino acid sequence in a DDpp fusion protein that increases ADCC include immunoglobulin effector domain sequences having one or more modifications corresponding to: IgG1-S298A, E333A, K334A; IgG1-S239D, I332E; IgG1-S239D, A330L, I332E; IgG1-P247I, A339D or Q; IgG1-D280H, K290S with or without S298D or V; IgG1-F243L, R292P, Y300L; IgG1-F243L, R292P, Y300L, P396L; and IgG1-F243L, R292P, Y300L, V305I, P396L; wherein the numbering of the residues in the Fc region is that of the EU index of Kabat et al. (Kabat et al., Sequences of proteins of Immunological Interest, 1991 Fifth edition, the contents of which is herein incorporated by reference in its entirety).

In other embodiments, a DDpp fusion protein comprises a sequence of an immunoglobulin effector domain that has been modified to decrease ADCC (see, e.g., Idusogie et al., J. Immunol. 166: 2571-2575 (2001); Sazinsky et al., PNAS 105: 20167-20172 (2008); Davis et al., J. Rheumatol. 34: 2204-2210 (2007); Bolt et al., Eur. J. Immunol. 23: 403-411 (1993); Alegre et al., Transplantation 57: 1537-1543 (1994); Xu et al., Cell Immunol. 200: 16-26 (2000); Cole et al., Transplantation 68: 563-571 (1999); Hutchins et al., PNAS 92: 11980-11984 (1995); Reddy et al., J. Immunol. 164: 1925-1933 (2000); WO97/11971; WO07/106585; US 2007/0148167A1; McEarchern et al., Blood 109: 1185-1192 (2007); Strohl, Curr. Op. Biotechnol. 20: 685-691 (2009); and Kumagai et al., J. Clin. Pharmacol. 47: 1489-1497 (2007), the contents of each of which is herein incorporated by reference in its entirety). Examples of immunoglobulin fragment sequence engineering modifications contained in an amino acid sequence in a DDpp fusion protein that decreases ADCC include immunoglobulin effector domain sequences having one or more modifications corresponding to: IgG1-K326W, E333S; IgG2-E333S; IgG1-N297A; IgG1-L234A, L235A; IgG2-V234A, G237A; IgG4-L235A, G237A, E318A; IgG4-S228P, L236E; IgG2-118-260; IgG4-261-447; IgG2-H268Q, V309L, A330S, A331S; IgG1-C220S, C226S, C229S, p268S; IgG1-C226S, C229S, E233P, L234V, L235A; or IgG1-L234F, L235E, P331S; wherein the numbering of the residues is that of the EU index of Kabat (Kabat et al., Sequences of Proteins of Immunological Interest, 1991 Fifth edition, the contents of which is herein incorporated by reference in its entirety).

In additional embodiments, a DDpp fusion protein comprises an amino acid sequence of an immunoglobulin effector domain, or a derivative of an immunoglobulin effector domain, that confers antibody-dependent cell phagocytosis (ADCP) to the DDpp fusion protein. In additional embodiments, a DDpp fusion protein comprises a sequence of an immunoglobulin effector domain that has been modified to increase antibody-dependent cell phagocytosis (ADCP); (see, e.g., Shields et al., J. Biol. Chem. 276: 6591-6604 (2001); Lazar et al., PNAS 103: 4005-4010 (2006); Stavenhagen et al., Cancer Res. 67: 8882-8890 (2007); Richards et al., Mol. Cancer Ther. 7: 2517-2527 (2008); Horton et al., Cancer Res. 68: 8049-8057 (2008), Zalevsky et al., Blood 113: 3735-3743 (2009); Bruckheimer et al., Neoplasia 11: 509-517 (2009); WO06/020114; Strohl, Curr. Op. Biotechnol. 20: 685-691 (2009); and WO04/074455, the contents of each of which is herein incorporated by reference in its entirety). Examples of immunoglobulin fragment engineering modifications contained in an amino acid sequence in a DDpp fusion protein that increases ADCP include immunoglobulin effector domain sequences having one or more modifications corresponding to: IgG1-S298A, E333A, K334A; IgG1-S239D, I332E; IgG1-S239D, A330L, I332E; IgG1-P247I, A339D or Q; IgG1-D280H, K290S with or without S298D or V; IgG1-F243L, R292P, Y300L; IgG1-F243L, R292P, Y300L, P396L; IgG1-F243L, R292P, Y300L, V305I, P396L; and IgG1-G236A, S239D, I332E; wherein the numbering of the residues is that of the EU index of Kabat et al. (Kabat et al., Sequences of proteins of Immunological Interest, 1991 Fifth edition, the contents of which is herein incorporated by reference in its entirety).

In other embodiments, a DDpp fusion protein comprises a sequence of an immunoglobulin effector domain that has been modified to decrease ADCP (see, e.g., Sazinsky et al., PNAS 105: 20167-20172 (2008); Davis et al., J. Rheumatol. 34: 2204-2210 (2007); Bolt et al., Eur. J. Immunol. 23: 403-411 (1993); Alegre et al., Transplantation 57: 1537-1543 (1994); Xu et al., Cell Immunol. 200: 16-20 (2000); Cole et al., Transplantation 68: 563-571 (1999); Hutchins et al., PNAS 92: 11980-11984 (1995); Reddy et al., J. Immunol. 164: 1925-1933 (2000); WO97/11971; WO07/106585; US 2007/0148167A1; McEarchern et al., Blood 109: 1185-1192 (2007); Strohl, Curr. Op. Biotechnol. 20: 685-691 (2009); and Kumagai et al., J. Clin. Pharmacol. 47: 1489-1497 (2007), the contents of each of which is herein incorporated by reference in its entirety). By way of example, DDpp fusion proteins can contain an antibody fragment or domain that contains one or more of the following modifications that decrease ADCC: IgG1-N297A; IgG1-L234A, L235A; IgG2-V234A, G237A; IgG4-L235A, G237A, E318A; IgG4-S228P, L236E; IgG2 EU sequence 118-260; IgG4-EU sequence 261-447; IgG2-H268Q, V309L, A330S, A331S; IgG1-C220S, C226S, C229S, p268S; IgG1-C226S, C229S, E233P, L234V, L235A; and IgG1-L234F, L235E, P331S; wherein the numbering of the residues is that of the EU index of Kabat et al. (Kabat et al., Sequences of proteins of Immunological Interest, 1991 Fifth edition, the contents of which is herein incorporated by reference in its entirety).

In additional embodiments, a DDpp fusion protein comprises an amino acid sequence of an immunoglobulin effector domain, or a derivative of an immunoglobulin effector domain, that confers complement-dependent cytotoxicity (CDC) to the DDpp fusion protein. In additional embodiments, a DDpp fusion protein comprises a sequence of an immunoglobulin effector domain that has been modified to increase complement-dependent cytotoxicity (CDC) (see, e.g., Idusogie et al., J. Immunol. 166: 2571-2575 (2001); Strohl, Curr. Op. Biotechnol. 20: 685-691 (2009); and Natsume et al., Cancer Res. 68: 3863-3872 (2008), the contents of each of which is herein incorporated by reference in its entirety). By way of example, DDpp fusion proteins can contain an antibody fragment or domain that contains one or more of the following modifications that increase CDC: IgG1-K326A, E333A; IgG1-K326W, E333S; IgG2-E333S; wherein the numbering of the residues is that of the EU index of Kabat et al. (Kabat et al., Sequences of proteins of Immunological Interest, 1991 Fifth edition, the contents of which is herein incorporated by reference in its entirety).

In additional embodiments, a DDpp fusion protein comprises an amino acid sequence of an immunoglobulin effector domain, or a derivative of an immunoglobulin effector domain, that confers the ability to bind FcgammaRIIb receptor to the DDpp fusion. In additional embodiments, a DDpp fusion protein comprises a sequence of an immunoglobulin effector domain that has been modified to increase inhibitory binding to FcgammaRIIb receptor (see, e.g., Chu et al., Mol. Immunol. 45: 3926-3933 (2008)). An example of an immunoglobulin fragment engineering modification contained in an amino acid sequence in a DDpp fusion protein that increases binding to inhibitory FcgammaRIIb receptor is IgG1-S267E, L328F.

In other embodiments, a DDpp fusion protein comprises a sequence of an immunoglobulin effector domain that has been modified to decrease CDC (see, e.g., WO97/11971; WO07/106585; US 2007/0148167A1; McEarchern et al., Blood 109: 1185-1192 (2007); Hayden-Ledbetter et al., Clin. Cancer 15: 2739-2746 (2009); Lazar et al., PNAS 103: 4005-4010 (2006); Bruckheimer et al., Neoplasia 11: 509-517 (2009); Strohl, Curr. Op. Biotechnol. 20: 685-691 (2009); and Sazinsky et al., PNAS 105: 20167-20172 (2008); the contents of each of which is herein incorporated by reference in its entirety). By way of example, DDpp fusion proteins can contain an antibody fragment or domain that contains one or more of the following modifications that decrease CDC: IgG1-S239D, A330L, I332E; IgG2-118-260; IgG4-261-447; IgG2-H268Q, V309L, A330S, A331S; IgG1-C226S, C229S, E233P, L234V, L235A; IgG1-L234F, L235E, P331S; and IgG1-C226S, p260S; wherein the numbering of the residues is that of the EU index of Kabat et al. (Kabat et al., Sequences of proteins of Immunological Interest, 1991 Fifth edition, the contents of which is herein incorporated by reference in its entirety).

The half-life of an IgG is mediated by its pH-dependent binding to the neonatal receptor FcRn. In certain embodiments, a DDpp fusion protein comprises an amino acid sequence of an immunoglobulin effector domain, or a derivative of an immunoglobulin effector domain, that confers the ability to bind neonatal receptor FcRn to the to the DDpp fusion. In certain embodiments, a DDpp fusion protein comprises a sequence of an immunoglobulin FcRn binding domain that has been modified to enhance binding to FcRn (see, e.g., Petkova et al., Int. Immunol. 18: 1759-1769 (2006); Dall'Acqua et al., J. Immunol. 169: 5171-5180 (2002); Oganesyan et al., Mol. Immunol. 46: 1750-1755 (2009); Dall'Acqua et al., J. Biol. Chem. 281: 23514-23524 (2006); Hinton et al., J. Immunol. 176: 346-356 (2006); Datta-Mannan et al., Drug Metab. Dispos. 35: 86-94 (2007); Datta-Mannan et al., J. Biol. Chem. 282: 1709-1717 (2007); WO06/130834; Strohl, Curr. Op. Biotechnol. 20: 685-691 (2009); and Yeung et al., J. Immunol. 182: 7663-7671 (2009); the contents of each of which is herein incorporated by reference in its entirety).

In additional embodiments, a DDpp fusion protein comprises a sequence of an immunoglobulin effector domain that has been modified to have a selective affinity for FcRn at pH 6.0, but not pH 7.4. By way of example, DDpp fusion proteins can contain an antibody fragment or domain that contains one or more of the following modifications that increase half-life: IgG1-M252Y, S254T, T256E; IgG1-T250Q, M428L; IgG1-H433K, N434Y; IgG1-N434A; and IgG1-T307A, E380A, N434A; wherein the numbering of the residues is that of the EU index of Kabat et al. (Kabat et al., Sequences of Proteins of Immunological Interest, 1991 Fifth edition, the contents of which is herein incorporated by reference in its entirety).

In other embodiments, a DDpp fusion protein comprises a sequence of an immunoglobulin effector domain that has been modified to decrease binding to FcRn (see, e.g., Petkova et al., Int. Immunol. 18: 1759-1769 (2006); Datta-Mannan et al., Drug Metab. Dispos. 35: 86-94 (2007); Datta-Mannan et al., J. Biol. Chem. 282: 1709-1717 (2007); Strohl, Curr. Op. Biotechnol. 20: 685-691 (2009); and Vaccaro et al., Nat. Biotechnol. 23: 1283-1288 (2005); the contents of each of which is herein incorporated by reference in its entirety). By way of example, DDpp fusion proteins can contain an antibody fragment or domain that contains one or more of the following modifications that decrease half-life: IgG1-M252Y, S254T, T256E; H433K, N434F, 436H; IgG1-I253A; and IgG1-P257I, N434H and D376V, N434H; wherein the numbering of the residues is that of the EU index of Kabat et al. (Kabat et al., Sequences of proteins of Immunological Interest, 1991 Fifth edition, the contents of which is herein incorporated by reference in its entirety).

According to another embodiment, DDpp fusion protein comprises an amino acid sequence corresponding to a immunoglobulin effector domain that has been modified to contain at least one substitution in its sequence corresponding to the Fc region (e.g., FC gamma) position selected from the group consisting of: 238, 239, 246, 248, 249, 252, 254, 255, 256, 258, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 332, 333, 334, 335, 337, 338, 340, 360, 373, 376, 378, 382, 388, 389, 398, 414, 416, 419, 430, 434, 435, 437, 438 and 439, wherein the numbering of the residues in the Fc region is according to the EU numbering system; of Kabat et al. (Kabat et al., Sequences of proteins of Immunological Interest, 1991 Fifth edition, the contents of which is herein incorporated by reference in its entirety). In a specific embodiment, the DDpp fusion protein comprises a sequence of an immunoglobulin effector domain derivative wherein at least one residue corresponding to position 434 is a residue selected from the group consisting of: A, W, Y, F and H. According to another embodiment, the DDpp fusion protein comprises a sequence of an immunoglobulin effector fragment derivative having the following respective substitutions S298A/E333A/K334A. In an additional embodiment, the DDpp fusion protein comprises an immunoglobulin effector domain derivative having a substitution corresponding to K322A. In another embodiment, the DDpp fusion protein comprises a sequence of an immunoglobulin effector domain derivative having one or any combination of the following substitutions K246H, H268D, E283L, S324G, S239D and I332E. According to yet another embodiment, a DDpp fusion protein comprises a sequence of an immunoglobulin effector domain derivative having substitutions corresponding to D265A/N297A.

In certain embodiments, a DDpp fusion protein comprises a sequence of an immunoglobulin effector domain that has been glycoengineered or mutated to increase effector function using techniques known in the art. For example, the inactivation (through point mutations or other means) of a constant region domain sequence contained in a DDpp may reduce Fc receptor binding of the circulating DDpp fusion protein thereby increasing tumor localization. In other cases it may be that constant region modifications consistent with certain provided embodiments, moderate complement binding and thus reduce the serum half-life and nonspecific association of a conjugated cytotoxin. Yet other modifications of the constant region may be used to modify disulfide linkages or oligosaccharide moieties that allow for enhanced localization due to increased antigen specificity or antibody flexibility. The resulting physiological profile, bioavailability and other biochemical effects of the modifications, such as tumor localization, biodistribution and serum half-life, can easily be measured and quantified using well know immunological techniques without undue experimentation.

In some embodiments, an immune effector cell comprises a cell surface receptor for an immunoglobulin or other peptide binding molecule, such as a receptor for an immunoglobulin constant region and including the class of receptors commonly referred to as "Fc receptors" ("FcR"s). A number of FcRs have been structurally and/or functionally characterized and are known in the art, including FcR having specific abilities to interact with a restricted subset of immunoglobulin heavy chain isotypes, or that interact with Fc domains with varying affinities, and/or which may be expressed on restricted subsets of immune effector cells under certain conditions (e.g., Kijimoto-Ochichai et al., Cell Mol. Life. Sci. 59: 648 (2002); Davis et al., Curr. Top. Microbiol. Immunol. 266: 85 (2002); Pawankar, Curr. Opin. Allerg. Clin. Immunol. 1: 3 (2001); Radaev et al., Mol. Immunol. 38: 1073 (2002); Wurzburg et al., Mol. Immunol. 38: 1063 (2002); Sulica et al., Int. Rev. Immunol. 20: 371 (2001); Underhill et al., Ann. Rev. Immunol. 20: 825 (2002); Coggeshall, Curr. Dir. Autoimm 5: 1 (2002); Mimura et al., Adv. Exp. Med. Biol. 495: 49 (2001); Baumann et al., Adv. Exp. Med. Biol. 495: 219 (2001); Santoso et al., Ital. Heart J. 2: 811 (2001); Novak et al., Curr. Opin. Immunol. 13: 721 (2001); Fossati et al., Eur. J. Clin. Invest. 31: 821 (2001)); the contents of each of which is herein incorporated by reference in its entirety.

Cells that are capable of mediating ADCC are examples of immune effector cells. Other immune effector cells include Natural Killer cells, tumor-infiltrating T lymphocytes (TILs), cytotoxic T lymphocytes, and granulocytic cells such as cells that comprise allergic response mechanisms Immune effector cells thus include, but are not limited to, cells of hematopoietic origin including cells at various stages of differentiation within myeloid and lymphoid lineages and which may (but need not) express one or more types of functional cell surface FcR, such as T lymphocytes, B lymphocytes, NK cells, monocytes, macrophages, dendritic cells, neutrophils, basophils, eosinophils, mast cells, platelets, erythrocytes, and precursors, progenitors (e.g., hematopoietic stem cells), as well as quiescent, activated, and mature forms of such cells. Other immune effector cells may include cells of non-hematopoietic origin that are capable of mediating immune functions, for example, endothelial cells, keratinocytes, fibroblasts, osteoclasts, epithelial cells, and other cells Immune effector cells can also include cells that mediate cytotoxic or cytostatic events, or endocytic, phagocytic, or pinocytotic events, or that effect induction of apoptosis, or that effect microbial immunity or neutralization of microbial infection, or cells that mediate allergic, inflammatory, hypersensitivity and/or autoimmune reactions.

DDpp Fusion Proteins with Increased Half-Life

The disclosed DDpp can be fused or complexed to a second peptide domain increases the half-life or stability of the DDpp.

In one aspect, the DDpp further comprises one or more amino acids that facilitate synthesis, handling, or use of the peptide, including, but not limited to, one or two lysines at the N-terminus and/or C-terminus to increase solubility of the polypeptide. Suitable fusion proteins include, but are not limited to, proteins comprising a DDpp linked to one or more polypeptides, polypeptide fragments, or amino acids not generally recognized to be part of the protein sequence. In one aspect, a fusion peptide comprises the entire amino acid sequences of two or more peptides or, alternatively, comprises portions (fragments) of two or more peptides. In some aspects, a peptide (e.g., Protein S-binding peptide) is operably linked to, for instance, one or more of the following: a marker protein, a peptide that facilitates purification, a peptide sequence that promotes formation of multimeric proteins, or a fragment of any of the foregoing. Suitable fusion partners include, but are not limited to, a His tag, a FLAG tag, a strep tag, and a myc tag.

In some embodiments, the DDpp is fused to one or more moieties that enhance the half-life of the polypeptide. Half-life can be increased by for example, increasing the molecular weight of the DDpp to avoid renal clearance and/or incorporating a binding domain for FcRn-mediated recycling pathway. In one embodiment, the DDpp is fused to, or chemically conjugated to, an albumin polypeptide or a fragment thereof (e.g., human serum albumin (HSA)). In particular embodiments, the fused or chemically conjugated albumin fragment comprises 10%, 25%, 50%, or 75% of the full length albumin protein. In additional or alternative embodiments, the DDpp is fused to or complexed with an albumin binding domain or fatty acid that binds albumin when administered in vivo. An example of an albumin binding domain is "albu-tag," a moiety derived from on 4-(p-iodophenyl)-butanoic acid (Dumelin et al., Angew Chem. Int. Ed Engl. 47: 3196-3201 (2008)).

In one embodiment, the DDpp is fused to, or chemically conjugated to, a transferrin polypeptide or a fragment thereof (e.g., human transferrin). In particular embodiments, the fused or chemically conjugated transferrin fragment comprises 10%, 25%, 50%, or 75% of the full length transferrin protein. In additional or alternative embodiments, the DDpp is fused to or complexed with a transferrin binding domain that binds transferrin when administered in vivo.

In some embodiments, the DDpp is fused to, or chemically conjugated to a proline-alanine-serine multimer (PA-Sylation; XL-Protein GmbH), a non-exact repeat peptide sequence (XTENylation, rPEG), a homopolymer of glycine residues (HAPylation), elastin-like repeat(s) sequences (ELPylation; see for example, U.S. Pat. Appl. No. 61/442, 106, the contents of which is herein incorporated by reference in its entirety), an artificial GLK (GLK fusion; Huang et al., Eur. J. Pharm. Biopharm. 72: 435-41 (2010)), or a CTP peptide from human CG beta-subunit (CTP fusion).

Additional DDpp Fusion Proteins

In some embodiments, the DDpp fusion protein specifically binds BCMA, CD123, CS1, HER2, AFP, and/or AFP p26, and further binds a disease-related antigen. The disease-related antigen can be an antigen characteristic of a cancer, and/or of a particular cell type (e.g., a hyperproliferative cell), and/or of a pathogen (e.g., a bacterial cell (e.g., tuberculosis, smallpox, and anthrax), a virus (e.g., HIV), a parasite (e.g., malaria and leishmaniosis), a fungal infection, a mold, a mycoplasm, a prion antigen, or an antigen associated with a disorder of the immune system. In further embodiment, the DDpp fusion protein is conjugated to a therapeutic or cytotoxic agent.

In an additional embodiment, a DDpp fusion protein is linked to one or more chemical moieties (e.g., labels) that facilitate detection, multimerization, binding with an interaction partner, or characterization of DDpp activity. An exemplary chemical moiety is biotin. Other moieties suitable for conjugation to the DDpp include, but are not limited to, a photosensitizer, a dye, a fluorescence dye, a radionuclide, a radionuclide-containing complex, an enzyme, a toxin, and a cytotoxic agent. Photosensitizers include, e.g., Photofrin, Visudyne, Levulan, Foscan, Metvix, Hexvix®, Cysview™, Laserphyrin, Antrin, Photochlor, Photosens, Photrex, Lumacan, Cevira, Visonac, BF-200 ALA, and Amphinex. In additional embodiments, a His tag, a FLAG tag, a strep tag, or a myc tag is conjugated to the DDpp.

In another embodiment, the DDpp fusion protein comprises a DD that binds BCMA, CD123, CS1, HER2, AFP, AFP p26, or a fragment thereof, and further binds a peptide tag present on a target of interest. Such peptide tags provide a useful means by which to detect and/or attach targets of interest containing the peptide tags. In one embodiment, the DDpp fusion protein specifically binds a peptide tag selected from the group: a hexahistidyl (His6) tag, a myc tag or a FLAG tag. Other peptide tags are described herein or otherwise known in the art.

DDpp Fusion Proteins with an Epitope Tag

In some embodiments, the DDpp fusion protein comprises a peptide epitope tag. In some embodiments, the peptide tag is selected from the group consisting of a hexahistidyl (His6) tag, a myc tag and a FLAG tag. In additional embodiments, peptide tags include, but are not limited to, avitag (allows biotinylation of the tag and isolation with streptavidin), calmodulin, E-tag, hemagglutinin (HA), S-tag, SBP-tag, softag 1, streptavidin, tetra or polycysteine, V5, VSV, and Xpress tag. Additionally polyhistidyl tags (other than 6 residues) can be used. In additional embodiments, covalent peptide tags, protein tags, and the like can be used. Covalent peptide tags include, but are not limited to, isopeptag (covalently binds pilinC protein), Spytag (covalently binds to the SpyCatcher protein), and Snooptag (covalently binds to the SnoopCatcher protein). In still additional embodiments, protein tags, including but not limited to biotin carboxyl carrier protein (BCCP), glutathione-s-transferase, green fluorescent protein (or other fluorophore), Halo tag, Nus tag, thioredoxin, and Fc tags may optionally be used. In still additional embodiments, multiple types of tags may be used. In still additional embodiments, no tag is used. In still additional embodiments, the DDpp fusion protein comprises a removable tag. Any combination of extracellular, transmembrane and intracellular domains disclosed herein may be used, depending on the embodiment.

DDpp Linkers

The terms "linker" and spacer are used interchangeably herein to refer to a peptide or other chemical linkage that functions to link otherwise independent functional domains. In one embodiment, a linker in a DDpp is located between a DDpp and another polypeptide component containing an otherwise independent functional domain. Suitable linkers for coupling the two or more linked DDpp will be clear to the persons skilled in the art and may generally be any linker used in the art to link peptides, proteins or other organic molecules. In particular embodiments, such a linker is suitable for constructing proteins or polypeptides that are intended for pharmaceutical use.

Suitable linkers for operably linking a DDpp and an additional component of a DDpp fusion protein in a single-chain amino acid sequence include but are not limited to, polypeptide linkers such as glycine linkers, serine linkers, mixed glycine/serine linkers, glycine- and serine-rich linkers or linkers composed of largely polar polypeptide fragments.

In one embodiment, the linker is made up of a majority of amino acids selected from glycine, alanine, proline, asparagine, glutamine, and lysine. In one embodiment, the linker is made up of a majority of amino acids selected from glycine, alanine, proline, asparagine, aspartic acid, threonine, glutamine, and lysine. In one embodiment, the DDpp fusion protein linker is made up of one or more of the amino acids selected from glycine, alanine, proline, asparagine, glutamine, and lysine. In one embodiment, the DDpp fusion protein linker is made up of one or more of the amino acids selected from glycine, alanine, proline, asparagine, aspartic acid, threonine, glutamine, and lysine. In another embodiment, the DDpp fusion protein linker is made up of a majority of amino acids that are sterically unhindered. In another embodiment, a linker in which the majority of amino acids are glycine, serine, and/or alanine. In some embodiments, the peptide linker is selected from polyglycines (such as (Gly)$_5$ (SEQ ID NO: 975), and (Gly)$_8$ (SEQ ID NO: 976), poly(Gly-Ala), and polyalanines. In some embodiments, the peptide linker contains the sequence of Gly-Gly-Gly-Gly-Thr-Gly-Gly-Gly-Gly-Ser (SEQ ID NO: 4). In some embodiments, the peptide linker contains the sequence of Gly-Gly-Gly-Gly-Asp-Gly-Gly-Gly-Gly-Ser (SEQ ID NO: 5).

In one embodiment, a DDpp fusion comprises a DDpp directly attached (i.e., without a linker) to another component of the DDpp fusion protein. In one embodiment, a DDpp fusion comprises at least 2, at least 3, at least 4, DDpp directly attached to another component of the DDpp fusion.

In another embodiment, a DDpp can be operably linked to another component of a DDpp fusion protein through a linker. DDpp fusion proteins can contain a single linker, multiple linkers, or no linkers. In one embodiment, a DDpp fusion comprises a DDpp operably linked to another component of the DDpp fusion protein through a linker peptide. In one embodiment, a DDpp fusion comprises at least 2, 3, 4, or 5 DD operably linked to another component of the DDpp fusion protein through a linker peptide.

Linkers can be of any size or composition so long as they are able to operably link a DDpp in a manner that enables the DDpp to bind a target of interest such as BCMA, CD123, CS1, HER2, AFP, or AFP p26. In some embodiments, linkers are about 1 to about 100 amino acids, about 1 to 50 amino acids, about 1 to 20 amino acids, about 1 to 15 amino acids, about 1 to 10 amino acids, about 1 to 5 amino acids, about 2 to 20 amino acids, about 2 to 15 amino acids, about 2 to 10 amino acids, or about 2 to 5 amino acids. It should be clear that the length, the degree of flexibility and/or other properties of the linker(s) may have some influence on the properties of the provided DD containing proteins, including but not limited to the affinity, specificity or avidity for a target of interest, or for one or more other target proteins of interest. When two or more linkers are used in the DDpp fusion proteins, these linkers may be the same or different. In the context and disclosure provided herein, a person skilled in the art will be able to routinely determine the optimal linker composition and length for the purpose of operably linking a DDpp and other components of a DDpp fusion protein.

The linker can also be a non-peptide linker such as an alkyl linker, or a PEG linker. For example, alkyl linkers such as —NH—(CH2)s-C(0)-, wherein s=2-20 can be used. These alkyl linkers may further be substituted by any non-sterically hindering group such as lower alkyl (e.g., C1-C6) lower acyl, halogen (e.g., Cl, Br), CN, NH2, phenyl, etc. An exemplary non-peptide linker is a PEG linker. In certain embodiments, the PEG linker has a molecular weight of about 100 to 5000 kDa, or about 100 to 500 kDa.

Suitable linkers for coupling DDpp fusion protein components by chemical cross-linking include, but are not limited to, homo-bifunctional chemical cross-linking compounds such as glutaraldehyde, imidoesters such as dimethyl adipimidate (DMA), dimethyl suberimidate (DMS) and dimethyl pimelimidate (DMP) or N-hydroxysuccinimide (NHS) esters such as dithiobis(succinimidylpropionate) (DSP) and dithiobis (sulfosuccini-midylpropionate) (DTSSP). Examples of suitable linkers for coupling DDpp fusion protein components of hetero-bifunctional reagents for cross-linking include, but are not limited to, cross-linkers with one amine-reactive end and a sulfhydryl-reactive moiety at the other end, or with a NHS ester at one end and an SH-reactive group (e.g., a maleimide or pyridyl).

In additional embodiments, one or more of the linkers in the DDpp fusion protein is cleavable. Examples of cleavable linkers include, without limitation, a peptide sequence recognized by proteases (in vitro or in vivo) of varying type, such as Tev, thrombin, factor Xa, plasmin (blood proteases), metalloproteases, cathepsins (e.g., GFLG, etc.), and proteases found in other corporeal compartments.

In one embodiment, the linker is a "cleavable linker" that facilitates the release of a DDpp or cytotoxic agent in a cell. For example, an acid-labile linker (e.g., hydrazone), protease-sensitive (e.g., peptidase-sensitive) linker, photolabile linker, dimethyl linker or disulfide-containing linker (Chari, Can. Res. 52: 127-131 (1992); U.S. Pat. No. 5,208,020; U.S. Appl. Pub. No. 20090110753; the contents of each of which is herein incorporated by reference in its entirety) can be used wherein it is desirable that the covalent attachment between a DDpp or a cytotoxic agent and the fusion partner is intracellularly cleaved when the composition is internalized into the cell. The terms "intracellularly cleaved" and "intracellular cleavage" refer to a metabolic process or reaction inside a cell on an DDpp drug conjugate whereby the covalent attachment, i.e., linked via a linker between the DDpp and cytotoxic agent, DDpp and fusion partner, or between two DDpp is broken, resulting in the free DDpp and/or cytotoxic agent dissociated inside the cell.

Linker optimization can be evaluated using techniques described herein and/or otherwise known in the art. In some embodiments, linkers do not disrupt the ability of a DDpp to bind a target molecule and/or another DDpp fusion protein component such as an antibody domain or fragment to bind an antigen.

DDpp as Chemical Conjugates

DDpp fusion proteins that promote specific binding to targets of interest can be chemically conjugated with a variety of compound such as fluorescent dyes, radioisotopes, chromatography compositions (e.g., beads, resins, gels, etc.) and chemotherapeutic agents. DDpp conjugates have uses that include but are not limited to diagnostic, analytic, manufacturing and therapeutic applications.

The inherent lack of cysteines in the DD sequence provides the opportunity for introduction of unique cysteines for purposes of site-specific conjugation.

In some embodiments, the DDpp (e.g., a DDpp fusion protein) contains at least one reactive residue. Reactive residues are useful, for example, as sites for the attachment of conjugates such as chemotherapeutic drugs. The reactive residue can be, for example, a cysteine, a lysine, or another reactive residue. Thus, a cysteine can be added to a DDpp at either the N- or C-terminus, or within the DDpp sequence. A cysteine can be substituted for another amino acid in the sequence of a DDpp. In addition, a lysine can be added to a DDpp at either end or within the DDpp sequence and/or a lysine can be substituted for another amino acid in the sequence of a DDpp. In one embodiment, a reactive residue (e.g., cysteine, lysine, etc.) is located in a loop sequence of a DD (e.g., amino acid residues 22-24 and 46-49 of SEQ ID NOS: 11-949, and 950). In one embodiment, a reactive residue is located between components of a DDpp fusion, e.g., in a linker located between a DDpp and other component of a DDpp fusion protein. The reactive residue (e.g., cysteine, lysine, etc.) can also be located within the sequence of a DDpp, or other component of the DDpp fusion protein. In one embodiment, a DDpp or a DDpp fusion protein comprises at least one, at least two, at least three reactive residues. In one embodiment, a DDpp such as a DDpp fusion protein comprises at least one, at least two, or at least three, cysteine residues.

BCMA-binding DDpp

In some embodiments, a DD of the DDpp specifically binds BCMA. In further embodiments, a DD of the DDpp specifically binds BCMA having an amino acid sequence consisting of SEQ ID NO: 7. In some embodiments, the DDpp comprises an amino acid sequence selected from the group consisting of SEQ ID NO: 11-305, and 306. In other embodiments, the BCMA-binding DDpp comprises a variant of an amino acid sequence selected from the group consisting of SEQ ID NO: 11-305, and 306.

In some embodiments, the BCMA-binding DDpp comprises multiple target-binding domains that bind a single target (e.g., dimers, trimers, etc.). In some embodiments, the DDpp comprises 2, 3, 4, 5, or more than 5, DD that specifically bind BCMA and that have an amino acid sequence selected from the group consisting of SEQ ID NO: 11-305, and 306. In some embodiments, the DDpp comprises 2, 3, 4, 5, or more than 5, DD that have the same sequence. In some embodiments, the DDpp comprises 2, 3, 4, 5 or more than 5, DD that specifically bind to different epitopes of BCMA and that have an amino acid sequence selected from the group consisting of SEQ ID NO: 11-305, and 306. In some embodiments, the DDpp comprises a DD that specifically binds BCMA and further comprises 2, 3, 4, 5 or more than 5, additional different DDs or target-binding binding domains (e.g., scFvs) that specifically bind to BCMA or a different target antigen. In some embodiments, the DDpp comprises a DD that specifically binds BCMA (e.g., a DD having an amino acid sequence selected from the group consisting of SEQ ID NO: 11-305, and 306) and further comprises one or more additional DDs or other target-binding binding domains that bind one or more antigens expressed on the surface of a B cell. In some embodiments, the DDpp comprises a DD that specifically binds BCMA e.g., a DD having an amino acid sequence selected from the group consisting of SEQ ID NO: 11-305, and 306) and further comprises one or more additional DDs or other target-binding binding domains that bind one or more cancer antigens. In some embodiments, the DDpp comprises a DD that specifically binds BCMA (e.g., a DD having an amino acid sequence selected from the group consisting of SEQ ID NO: 11-305, and 306) and specifically binds 2, 3, 4, 5, or more than 5, different targets. In further embodiments, the DDpp comprises a DD that specifically binds BCMA (e.g., a DD having an amino acid sequence selected from the group consisting of SEQ ID NO: 11-305, and 306) and specifically binds 2, 3, 4, 5, or more than 5, different cancer antigens. In some embodiments, the DDpp comprises a DD that specifically binds BCMA (e.g., a DD having an amino acid sequence selected from the group consisting of SEQ ID NO: 11-305, and 306) and specifically binds 2, 3, 4, 5, or more than 5, different cancer antigens expressed on the surface of a cancer cell. In some embodiments, the DDpp comprises a DD that specifically binds BCMA (e.g., a DD having an amino acid sequence selected from the group consisting of SEQ ID NO: 11-305, and 306) and specifically binds 2, 3, 4, 5, or more than 5, cancer antigens expressed on the surface of different cancer cells.

In some embodiments, the DDpp comprises a variant of a BCMA-binding DD disclosed herein (reference DD) that retains the ability to specifically bind BCMA. In some embodiments, the sequence of the BCMA-binding DD variant contains 1, 2, 3, 4, 5, 6, 7, 8, 9, or 10, 1-3, 1-5, or 1-10, conservative or non-conservative substitutions compared to a reference BCMA-binding DD having an amino acid sequence selected from the group consisting of SEQ ID NO: 11-305, and 306. In some embodiments, the sequence of the BCMA-binding DD variant contains 1, 2, 3, 4, 5, 6, 7, 8, 9, or 10, 1-3, 1-5, or 1-10, conservative substitutions compared to a reference BCMA-binding DD having an amino acid sequence selected from the group consisting of SEQ ID NO: 11-305, and 306. In some embodiments, the sequence of the BCMA-binding DD variant contains 1, 2, 3, 4, 5, 6, 7, 8, 9, or 10, 1-3, 1-5, or 1-10, non-conservative substitutions compared to a reference BCMA-binding DD having an amino acid sequence selected from the group consisting of SEQ ID NO: 11-305, and 306.

In some embodiments, the sequence of the BCMA-binding DD variant contains a total of 1, 2, 3, 4, 5, 6, 7, 8, 9, or 10, 1-3, 1-5, or 1-10, conservative or non-conservative substitutions in positions corresponding to amino acid residues 1-22, 29-46, and 52-72, of a reference BCMA-binding DD having an amino acid sequence selected from the group consisting of SEQ ID NO: 11-305, and 306. In some embodiments, the sequence of the BCMA-binding DD variant contains a total of 1, 2, 3, 4, 5, 6, 7, 8, 9, or 10, 1-3, 1-5, or 1-10, conservative substitutions in positions corresponding to amino acid residues 1-22, 29-46, and 52-72, of a reference BCMA-DD having an amino acid sequence selected from the group consisting of SEQ ID NO: 11-305, and 306. In some embodiments, the sequence of the BCMA-binding DD variant contains a total of 1, 2, 3, 4, 5, 6, 7, 8, 9, or 10, 1-3, 1-5, or 1-10, non-conservative substitutions in positions corresponding to amino acid residues 1-22, 29-46, and 52-72, of a reference BCMA-binding DD having an amino acid sequence selected from the group consisting of SEQ ID NO: 11-305, and 306.

In some embodiments, the sequence of the BCMA-binding DD variant contains a total of 1, 2, 3, 4, 5, 6, 7, 8, 9, or 10, 1-3, 1-5, or 1-10, conservative or non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference BCMA-binding DD having an amino acid sequence selected from the group consisting of SEQ ID NO: 11-305, and 306. In some embodiments, the sequence of the BCMA-binding DD variant contains a total of 1, 2, 3, 4, 5, 6, 7, 8, 9, or 10, 1-3, 1-5, or 1-10, conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 11-305, and 306. In some embodiments, the sequence of the BCMA-binding DD variant contains a total of 1, 2, 3, 4, 5, 6, 7, 8, 9, or 10, 1-3, 1-5, or 1-10, non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 11-305, and 306.

In some embodiments, the disclosure provides a BCMA-binding DDpp that completely or partially (e.g., overlap with an epitope) block binding of a reference DD to BCMA, wherein the reference DD has an amino acid sequence selected from SEQ ID NO: 11-305, and 306. In other embodiments, the disclosure provides BCMA-binding DDpp that bind to the same epitope of BCMA as a reference DD consisting of an amino acid sequence selected from SEQ ID NO: 11-305, and 306.

In some embodiments, the DDpp is a fusion protein comprising a DD that specifically binds BCMA. In some embodiments, the DD specifically binds a BCMA protein having an amino acid sequence consisting of SEQ ID NO: 7. In some embodiments, the BCMA-binding DDpp fusion protein comprises an amino acid sequence selected from the group consisting of SEQ ID NO: 11-305, and 306. In other embodiments, the DDpp comprises a variant of an amino acid sequence selected from the group consisting of SEQ ID NO: 11-305, and 306. In some embodiments, the DDpp fusion protein comprises a full-length antibody or a portion (fragment) of an antibody. In some embodiments, the DDpp fusion protein comprises a full length IgG antibody (e.g., IgG1, IgG2, IgG2, or IgG4). In further embodiments, the DDpp fusion protein comprises a full length antibody that specifically binds a cancer antigen. In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the BCMA-binding DDpp is an Fc fusion protein. In further embodiments, the Fc protein comprises a variant human Fc domain.

In some embodiments, the DDpp fusion protein comprises a BCMA-binding DD operably linked to a serum protein. In some embodiments, the DDpp fusion protein comprises an amino acid sequence selected from the group consisting of SEQ ID NO: 11-305, and 306. In other embodiments, the BCMA-binding DDpp fusion protein comprises a variant of an amino acid sequence selected from the group consisting of SEQ ID NO: 11-305, and 306. In further embodiments, the DDpp fusion protein comprises human serum albumin or a fragment thereof. In some embodiments, the DDpp fusion protein comprises AFP or AFP p26, or a fragment thereof. In some embodiments, the DDpp fusion protein comprises AFP (e.g., SEQ ID NO: 9), or a fragment thereof. In other embodiments, the DDpp fusion protein comprises AFP p26 (SEQ ID NO: 10), or a fragment thereof. In some embodiments, the DDpp fusion protein comprises a polypeptide having the sequence of SEQ ID NO: 10, 968, 969, 970, 971, 972, 973, or 974. In some embodiments, the DDpp fusion protein contains a fragment of a serum protein or an antigenic fragment of a serum protein (e.g., AFP, and AFP p26). In some embodiments, the DDpp fusion protein comprises a fragment consisting of 5-500, 5-400, 5-300, 5-200, 5-100, 5-50, 10-500, 10-400, 10-300, 10-200, 10-100, or 10-50 amino acids of a serum protein.

In some embodiments, the BCMA-binding DDpp fusion protein comprises the extracellular domain of a receptor or a fragment thereof. In some embodiments, the DDpp fusion protein comprises a DD that comprises an amino acid sequence selected from the group consisting of SEQ ID NO: 11-305, and 306. In other embodiments, the BCMA-binding DDpp fusion protein comprises a variant of an amino acid sequence selected from the group consisting of SEQ ID NO: 11-305, and 306. In further embodiments, the BCMA-binding DDpp fusion protein comprises the extracellular domain of CD123 (SEQ ID NO: 8), or a fragment thereof. In some embodiments, the BCMA-binding DDpp fusion protein comprises the extracellular domain of of a receptor selected from the group consisting of: CD19, CD20, CD22, HVEM, BTLA, DR3, CD37; TSLPR, IL7R, and gp96, or a fragment thereof.

In some embodiments, the BCMA-binding DDpp fusion protein contains a fragment consisting of 5-500, 5-400, 5-300, 5-200, 5-100, 5-50, 10-500, 10-400, 10-300, 10-200, 10-100, or 10-50 amino acids of an extracellular domain, of a cell surface receptor. In some embodiments, the DDpp fusion protein contains a fragment of an extracellular domain of BCMA (SEQ ID NO: 7) or CD123 (SEQ ID NO: 8). In some embodiments, the DDpp fusion protein contains a fragment of an extracellular domain of BCMA (SEQ ID NO: 7), CD123 (SEQ ID NO: 8), or CS1 (SEQ ID NO: 965). In some embodiments, the DDpp contains a fragment of an extracellular domain, of a receptor selected from the group consisting of: CD19, CD20, CD22, HVEM, BTLA, DR3, CD37; TSLPR, IL7R, and gp96.

In additional embodiments, the BCMA-binding DDpp fusion protein comprises an intracellular protein (e.g., a nuclear protein) or a fragment thereof. In some embodiments, the DDpp fusion protein comprises a DD that comprises an amino acid sequence selected from the group consisting of SEQ ID NO: 11-305, and 306. In other embodiments, the BCMA-binding DDpp fusion protein comprises a variant of an amino acid sequence selected from the group consisting of SEQ ID NO: 11-305, and 306. In some embodiments, the BCMA-binding DDpp fusion protein comprises a fragment consisting of 5-500, 5-400, 5-300, 5-200, 5-100, 5-50, 10-500, 10-400, 10-300, 10-200, 10-100, or 10-50 amino acid residues of an intracellular protein (e.g., a nuclear protein).

CD123-Binding DDpp

In some embodiments, a DD of the DDpp specifically binds CD123. In further embodiments, the DD specifically binds CD123 having an amino acid sequence consisting of SEQ ID NO: 8. In some embodiments, the DDpp comprises an amino acid sequence selected from the group consisting of SEQ ID NO: SEQ ID NO: 307-739, and 740. In other embodiments, the DDpp comprises a variant of an amino acid sequence selected from the group consisting of SEQ ID NO: SEQ ID NO: 307-739, and 740.

In some embodiments, the CD123-binding DDpp comprises multiple target-binding domains that bind a single target (e.g., dimers, trimers, etc.). In some embodiments, the DDpp comprises 2, 3, 4, 5, or more than 5, DD that specifically bind CD123 and that have an amino acid sequence selected from the group consisting of SEQ ID NO: 307-739, and 740. In some embodiments, the DDpp comprises 2, 3, 4, 5, or more than 5, DD that have the same sequence. In some embodiments, the DDpp comprises 2, 3, 4, 5 or more than 5, DD that specifically bind to different epitopes of CD123 and that have an amino acid sequence selected from the group consisting of SEQ ID NO: 307-739, and 740. In some embodiments, the DDpp comprises a DD that specifically binds CD123 and further comprises 2, 3, 4, 5 or more than 5, additional different DDs or target-binding binding domains (e.g., scFvs) that specifically bind to CD123 or a different target antigen. In some embodiments, the DDpp comprises a DD that specifically binds CD123 (e.g., a DD having an amino acid sequence selected from the group consisting of SEQ ID NO: 307-739, and 740) and further comprises one or more additional DDs or other target-binding binding domains that bind one or more antigens expressed on the surface of a B cell. In some embodiments, the DDpp comprises a DD that specifically binds CD123 e.g., a DD having an amino acid sequence selected from the group consisting of SEQ ID NO: 307-739, and 740) and further comprises one or more additional DDs or other target-binding binding domains that bind one or more cancer antigens. In some embodiments, the DDpp comprises a DD that specifically binds CD123 (e.g., a DD having an amino acid sequence selected from the group consisting of SEQ ID NO: 307-739, and 740) and specifically binds 2, 3, 4, 5, or more than 5, different targets. In further embodiments, the DDpp comprises a DD that specifically binds CD123 (e.g., a DD having an amino acid sequence selected from the group consisting of SEQ ID NO: 307-739, and 740) and specifically binds 2, 3, 4, 5, or more than 5, different cancer antigens. In some embodiments, the DDpp comprises a DD that specifically binds CD123 (e.g., a DD having an amino acid sequence selected from the group consisting of SEQ ID NO: 307-739, and 740) and specifically binds 2, 3, 4, 5, or more than 5, different cancer antigens expressed on the surface of a cancer cell. In some embodiments, the DDpp comprises a DD that specifically binds CD123 (e.g., a DD having an amino acid sequence selected from the group consisting of SEQ ID NO: 307-739, and 740) and specifically binds 2, 3, 4, 5, or more than 5, cancer antigens expressed on the surface of different cancer cells.

In some embodiments, the DDpp comprises a variant of a CD123-binding DD disclosed herein (reference DD) that retains the ability to specifically bind CD123. In some embodiments, the sequence of the CD123-binding DD variant contains 1, 2, 3, 4, 5, 6, 7, 8, 9, or 10, 1-3, 1-5, or 1-10, conservative or non-conservative substitutions compared to a reference CD123-binding DD having an amino acid sequence selected from the group consisting of SEQ ID NO: 307-739, and 740. In some embodiments, the sequence of the CD123-binding DD variant contains 1, 2, 3, 4, 5, 6, 7, 8, 9, or 10, 1-3, 1-5, or 1-10, conservative substitutions compared to a reference CD123-binding DD having an amino acid sequence selected from the group consisting of SEQ ID NO: 307-739, and 740. In some embodiments, the sequence of the CD123-binding DD variant contains 1, 2, 3, 4, 5, 6, 7, 8, 9, or 10, 1-3, 1-5, or 1-10, non-conservative substitutions compared to a reference CD123-binding DD having an amino acid sequence selected from the group consisting of SEQ ID NO: 307-739, and 740.

In some embodiments, the sequence of the CD123-binding DD variant contains a total of 1, 2, 3, 4, 5, 6, 7, 8, 9, or 10, 1-3, 1-5, or 1-10, conservative or non-conservative substitutions in positions corresponding to amino acid residues 1-22, 29-46, and 52-72, of a reference CD123-binding DD having an amino acid sequence selected from the group consisting of SEQ ID NO: 4307-739, and 740. In some embodiments, the sequence of the CD123-binding DD variant contains a total of 1, 2, 3, 4, 5, 6, 7, 8, 9, or 10, 1-3, 1-5, or 1-10, conservative substitutions in positions corresponding to amino acid residues 1-22, 29-46, and 52-72, of a reference CD123-DD having an amino acid sequence selected from the group consisting of SEQ ID NO: 307-739, and 740. In some embodiments, the sequence of the CD123-binding DD variant contains a total of 1, 2, 3, 4, 5, 6, 7, 8, 9, or 10, 1-3, 1-5, or 1-10, non-conservative substitutions in positions corresponding to amino acid residues 1-22, 29-46, and 52-72, of a reference CD123-binding DD having an amino acid sequence selected from the group consisting of SEQ ID NO: 307-739, and 740.

In some embodiments, the sequence of the CD123-binding DD variant contains a total of 1, 2, 3, 4, 5, 6, 7, 8, 9, or 10, 1-3, 1-5, or 1-10, conservative or non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference CD123-binding DD having an amino acid sequence selected from the group consisting of SEQ ID NO: 307-739, and 740. In some embodiments, the sequence of the CD123-binding DD variant contains a total of 1, 2, 3, 4, 5, 6, 7, 8, 9, or 10, 1-3, 1-5, or 1-10, conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 307-739, and 740. In some embodiments, the sequence of the CD123-binding DD variant contains a total of 1, 2, 3, 4, 5, 6, 7, 8, 9, or 10, 1-3, 1-5, or 1-10, non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 307-739, and 740.

In some embodiments, the disclosure provides CD123-binding DDpp that completely or partially (e.g., overlap with an epitope) block binding of a reference DD to CD123, wherein the reference DD has an amino acid sequence selected from SEQ ID NO: 307-739, and 740. In other embodiments, the disclosure provides CD123-binding DDpp that bind to the same epitope of CD123as a a reference DD consisting of an amino acid sequence selected from SEQ ID NO: 307-739, and 740.

In some embodiments, the DDpp is a fusion protein comprising a DD that specifically binds CD123. In some embodiments, a DD of the DDpp fusion protein specifically binds CD123 having an amino acid sequence consisting of of SEQ ID NO: 8. In some embodiments, the DDpp comprises an amino acid sequence selected from the group consisting of SEQ ID NO: 307-739, and 740. In other embodiments, the DDpp comprises a variant of an amino acid sequence selected from the group consisting of SEQ ID NO: 307-739, and 740. In some embodiments, the DDpp fusion protein comprises a full-length antibody or a portion (fragment) of an antibody. In some embodiments, the DDpp fusion protein comprises a full length IgG antibody (e.g., IgG1, IgG2, IgG2, or IgG4). In further embodiments, the DDpp fusion protein comprises a full length antibody that specifically binds a cancer antigen. In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the CD123-binding DDpp is an Fc fusion protein.

In some embodiments, the DDpp is a fusion protein comprising a CD123-binding DD operably linked to a serum protein. In some embodiments, the CD123-binding DDpp fusion protein comprises an amino acid sequence selected from the group consisting of SEQ ID NO: 307-739, and 740. In other embodiments, the CD123-binding DDpp fusion protein comprises a variant of an amino acid sequence selected from the group consisting of SEQ ID NO: 307-739, and 740. In some embodiments, the CD123-binding DDpp fusion protein comprises all or a portion of human serum albumin. In some embodiments, the DDpp fusion protein comprises AFP (SEQ ID NO: 9), or a fragment thereof. In some embodiments, the CD123-binding DDpp fusion protein comprises AFP p26 (SEQ ID NO: 10), or a fragment thereof. In some embodiments, the CD123-binding DDpp fusion protein comprises a polypeptide having the sequence of SEQ ID NO: 10, 968, 969, 970, 971, 972, 973, or 974. In some embodiments, the DDpp fusion protein contains a fragment of a serum protein or an antigenic fragment of a serum protein (e.g., AFP, and AFP p26). In some embodiments, the DDpp fusion protein comprises a fragment consisting of 5-500, 5-400, 5-300, 5-200, 5-100, 5-50, 10-500, 10-400, 10-300, 10-200, 10-100, or 10-50 amino acids of a serum protein.

In some embodiments, the CD123-binding DDpp fusion protein comprises the extracellular domain of a receptor or a fragment thereof. In some embodiments, the DDpp fusion protein comprises a DD that comprises an amino acid sequence selected from the group consisting of SEQ ID NO: 307-739, and 740. In other embodiments, the CD123-binding DDpp fusion protein comprises a variant of an amino acid sequence selected from the group consisting of SEQ ID NO: 307-739, and 740. In further embodiments, the CD123-binding DDpp fusion protein comprises the extracellular domain of CD123 (SEQ ID NO: 8), or a fragment thereof. In some embodiments, the CD123-binding DDpp fusion protein comprises the extracellular domain of of a receptor selected from the group consisting of: CD19, CD20, CD22, HVEM, BTLA, DR3, CD37; TSLPR, IL7R, and gp96, or a fragment thereof.

In some embodiments, the CD123-binding DDpp fusion protein contains a fragment consisting of 5-500, 5-400, 5-300, 5-200, 5-100, 5-50, 10-500, 10-400, 10-300, 10-200, 10-100, or 10-50 amino acids of an extracellular domain, of a cell surface receptor. In some embodiments, the DDpp fusion protein contains a fragment of an extracellular domain of BCMA (SEQ ID NO: 7). In some embodiments, the DDpp fusion protein contains a fragment of an extracellular domain of CD123 (SEQ ID NO: 8). In some embodiments, the DDpp fusion protein contains a fragment of an extracellular domain of CS1 (SEQ ID NO: 965). In some embodiments, the DDpp contains a fragment of an extracellular domain, of a receptor selected from the group consisting of: CD19, CD20, CD22, HVEM, BTLA, DR3, CD37; TSLPR, IL7R, and gp96.

In additional embodiments, the CD123-binding DDpp fusion protein comprises an intracellular protein (e.g., a nuclear protein) or a fragment thereof. In some embodiments, the DDpp fusion protein comprises a DD that comprises an amino acid sequence selected from the group consisting of SEQ ID NO: 307-739, and 740. In other embodiments, the CD123-binding DDpp fusion protein comprises a variant of an amino acid sequence selected from the group consisting of SEQ ID NO: 307-739, and 740. In some embodiments, the CD123-binding DDpp fusion protein comprises a fragment consisting of 5-500, 5-400, 5-300, 5-200, 5-100, 5-50, 10-500, 10-400, 10-300, 10-200, 10-100, or 10-50 amino acid residues of an intracellular protein (e.g., a nuclear protein).

CS1-Binding DDpp

In some embodiments, a DD of the DDpp specifically binds CS1. In further embodiments, the DD specifically binds CS1 having an amino acid sequence consisting of SEQ ID NO: 965. In some embodiments, the DDpp comprises an amino acid sequence selected from the group consisting of SEQ ID NO: 896-909, and 910. In other embodiments, the DDpp comprises a variant of an amino acid sequence selected from the group consisting of SEQ ID NO: 896-909, and 910.

In some embodiments, the CS1-binding DDpp comprises multiple target-binding domains that bind a single target (e.g., dimers, trimers, etc.). In some embodiments, the DDpp comprises 2, 3, 4, 5, or more than 5, DD that specifically bind CS1 and that have an amino acid sequence selected from the group consisting of SEQ ID NO: 896-909, and 910. In some embodiments, the DDpp comprises 2, 3, 4, 5, or more than 5, DD that have the same sequence. In some embodiments, the DDpp comprises 2, 3, 4, 5 or more than 5, DD that specifically bind to different epitopes of CS1 and that have an amino acid sequence selected from the group consisting of SEQ ID NO: 896-909, and 910. In some embodiments, the DDpp comprises a DD that specifically binds CS1 and further comprises 2, 3, 4, 5 or more than 5, additional different DDs or target-binding binding domains (e.g., scFvs) that specifically bind to CS1 or a different target antigen. In some embodiments, the DDpp comprises a DD that specifically binds CS1 (e.g., a DD having an amino acid sequence selected from the group consisting of SEQ ID NO: 896-909, and 910) and further comprises one or more additional DDs or other target-binding binding domains that bind one or more antigens expressed on the surface of a B cell. In some embodiments, the DDpp comprises a DD that specifically binds CS1 e.g., a DD having an amino acid sequence selected from the group consisting of SEQ ID NO: 896-909, and 910) and further comprises one or more additional DDs or other target-binding binding domains that bind one or more cancer antigens. In some embodiments, the DDpp comprises a DD that specifically binds CS1 (e.g., a DD having an amino acid sequence selected from the group consisting of SEQ ID NO: 896-909, and 910) and specifically binds 2, 3, 4, 5, or more than 5, different targets. In further embodiments, the DDpp comprises a DD that specifically binds CS1 (e.g., a DD having an amino acid sequence selected from the group consisting of SEQ ID NO: 896-909, and 910) and specifically binds 2, 3, 4, 5, or more than 5, different cancer antigens. In some embodiments, the DDpp comprises a DD that specifically binds CS1 (e.g., a DD having an amino acid sequence selected from the group consisting of SEQ ID NO: 896-909, and 910) and specifically binds 2, 3, 4, 5, or more than 5, different cancer antigens expressed on the surface of a cancer cell. In some embodiments, the DDpp comprises a DD that specifically binds CS1 (e.g., a DD having an amino acid sequence selected from the group consisting of SEQ ID NO: 896-909, and 910) and specifically binds 2, 3, 4, 5, or more than 5, cancer antigens expressed on the surface of different cancer cells.

In some embodiments, the DDpp comprises a variant of a CS1-binding DD disclosed herein (reference DD) that retains the ability to specifically bind CS1. In some embodiments, the sequence of the CS1-binding DD variant contains 1, 2, 3, 4, 5, 6, 7, 8, 9, or 10, 1-3, 1-5, or 1-10, conservative or non-conservative substitutions compared to a reference CS1-binding DD having an amino acid sequence selected from the group consisting of SEQ ID NO: 896-909, and 910. In some embodiments, the sequence of the CS1-binding DD variant contains 1, 2, 3, 4, 5, 6, 7, 8, 9, or 10, 1-3, 1-5, or 1-10, conservative substitutions compared to a reference CS1-binding DD having an amino acid sequence selected from the group consisting of SEQ ID NO: 896-909, and 910. In some embodiments, the sequence of the CS1-binding DD variant contains 1, 2, 3, 4, 5, 6, 7, 8, 9, or 10, 1-3, 1-5, or 1-10, non-conservative substitutions compared to a reference CS1-binding DD having an amino acid sequence selected from the group consisting of SEQ ID NO: 896-909, and 910.

In some embodiments, the sequence of the CS1-binding DD variant contains a total of 1, 2, 3, 4, 5, 6, 7, 8, 9, or 10, 1-3, 1-5, or 1-10, conservative or non-conservative substitutions in positions corresponding to amino acid residues 1-22, 29-46, and 52-72, of a reference CS1-binding DD having an amino acid sequence selected from the group consisting of SEQ ID NO: 896-909, and 910. In some embodiments, the sequence of the CS1-binding DD variant contains a total of 1, 2, 3, 4, 5, 6, 7, 8, 9, or 10, 1-3, 1-5, or 1-10, conservative substitutions in positions corresponding to amino acid residues 1-22, 29-46, and 52-72, of a reference CS1-DD having an amino acid sequence selected from the group consisting of SEQ ID NO: 896-909, and 910. In some embodiments, the sequence of the CS1-binding DD variant contains a total of 1, 2, 3, 4, 5, 6, 7, 8, 9, or 10, 1-3, 1-5, or 1-10, non-conservative substitutions in positions corresponding to amino acid residues 1-22, 29-46, and 52-72, of a reference CS1-binding DD having an amino acid sequence selected from the group consisting of SEQ ID NO: 896-909, and 910.

In some embodiments, the sequence of the CS1-binding DD variant contains a total of 1, 2, 3, 4, 5, 6, 7, 8, 9, or 10, 1-3, 1-5, or 1-10, conservative or non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference CS1-binding DD having an amino acid sequence selected from the group consisting of SEQ ID NO: 896-909, and 910. In some embodiments, the sequence of the CS1-binding DD variant contains a total of 1, 2, 3, 4, 5, 6, 7, 8, 9, or 10, 1-3, 1-5, or 1-10, conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 896-909, and 910. In some embodiments, the sequence of the CS1-binding DD variant contains a total of 1, 2, 3, 4, 5, 6, 7, 8, 9, or 10, 1-3, 1-5, or 1-10, non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 896-909, and 910.

In some embodiments, the disclosure provides CS1-binding DDpp that completely or partially (e.g., overlap with an epitope) block binding of a reference DD to CS1, wherein the reference DD has an amino acid sequence selected from SEQ ID NO: 896-909, and 910. In other embodiments, the disclosure provides CS1-binding DDpp that bind to the same epitope of CS1 as a a reference DD consisting of an amino acid sequence selected from SEQ ID NO: 896-909, and 910.

In some embodiments, the DDpp is a fusion protein comprising a DD that specifically binds CS1. In some embodiments, a DD of the DDpp fusion protein specifically binds CS1 having an amino acid sequence consisting of of SEQ ID NO: 965. In some embodiments, the DDpp comprises an amino acid sequence selected from the group consisting of SEQ ID NO: 896-909, and 910. In other embodiments, the DDpp comprises a variant of an amino acid sequence selected from the group consisting of SEQ ID NO: 896-909, and 910. In some embodiments, the DDpp fusion protein comprises a full-length antibody or a portion (fragment) of an antibody. In some embodiments, the DDpp fusion protein comprises a full length IgG antibody (e.g., IgG1, IgG2, IgG2, or IgG4). In further embodiments, the DDpp fusion protein comprises a full length antibody that specifically binds a cancer antigen. In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the CS1-binding DDpp is an Fc fusion protein.

In some embodiments, the DDpp is a fusion protein comprising a CS1-binding DD operably linked to a serum protein. In some embodiments, the CS1-binding DDpp fusion protein comprises an amino acid sequence selected from the group consisting of SEQ ID NO: 896-909, and 910. In other embodiments, the CS1-binding DDpp fusion protein comprises a variant of an amino acid sequence selected from the group consisting of SEQ ID NO: 896-909, and 910. In some embodiments, the CS1-binding DDpp fusion protein comprises all or a portion of human serum albumin. In some embodiments, the DDpp fusion protein comprises AFP (SEQ ID NO: 9), or a fragment thereof. In some embodiments, the CS1-binding DDpp fusion protein comprises AFP p26 (SEQ ID NO: 10), or a fragment thereof. In some embodiments, the CS1-binding DDpp fusion protein comprises a polypeptide having the sequence of SEQ ID NO: 10, 968, 969, 970, 971, 972, 973, or 974. In some embodiments, the DDpp fusion protein contains a fragment of a serum protein or an antigenic fragment of a serum protein (e.g., AFP, and AFP p26). In some embodiments, the DDpp fusion protein comprises a fragment consisting of 5-500, 5-400, 5-300, 5-200, 5-100, 5-50, 10-500, 10-400, 10-300, 10-200, 10-100, or 10-50 amino acids of a serum protein.

In some embodiments, the CS1-binding DDpp fusion protein comprises the extracellular domain of a receptor or a fragment thereof. In some embodiments, the DDpp fusion protein comprises a DD that comprises an amino acid sequence selected from the group consisting of SEQ ID NO: 896-909, and 910. In other embodiments, the CS1-binding DDpp fusion protein comprises a variant of an amino acid sequence selected from the group consisting of SEQ ID NO: 896-909, and 910. In further embodiments, the CS1-binding DDpp fusion protein comprises the extracellular domain of CS1 (SEQ ID NO: 965), or a fragment thereof. In some embodiments, the CS1-binding DDpp fusion protein comprises the extracellular domain of a receptor selected from the group consisting of: CD19, CD20, CD22, HVEM, BTLA, DR3, CD37; TSLPR, IL7R, and gp96, or a fragment thereof.

In some embodiments, the CS1-binding DDpp fusion protein contains a fragment consisting of 5-500, 5-400, 5-300, 5-200, 5-100, 5-50, 10-500, 10-400, 10-300, 10-200, 10-100, or 10-50 amino acids of an extracellular domain, of a cell surface receptor. In some embodiments, the DDpp fusion protein contains a fragment of an extracellular domain of BCMA (SEQ ID NO: 7). In some embodiments, the DDpp fusion protein contains a fragment of an extracellular domain of CD123 (SEQ ID NO: 8). In some embodiments, the DDpp fusion protein contains a fragment of an extracellular domain of CS1 (SEQ ID NO: 965). In some embodiments, the DDpp contains a fragment of an extracellular domain, of a receptor selected from the group consisting of: CD19, CD20, CD22, HVEM, BTLA, DR3, CD37; TSLPR, IL7R, and gp96.

In additional embodiments, the CS1-binding DDpp fusion protein comprises an intracellular protein (e.g., a nuclear protein) or a fragment thereof. In some embodiments, the DDpp fusion protein comprises a DD that comprises an amino acid sequence selected from the group consisting of SEQ ID NO: 896-909, and 910. In other embodiments, the CS1-binding DDpp fusion protein comprises a variant of an amino acid sequence selected from the group consisting of SEQ ID NO: 896-909, and 910. In some embodiments, the CS1-binding DDpp fusion protein comprises a fragment consisting of 5-500, 5-400, 5-300, 5-200, 5-100, 5-50, 10-500, 10-400, 10-300, 10-200, 10-100, or 10-50 amino acid residues of an intracellular protein (e.g., a nuclear protein).

HER2-Binding DDpp

In some embodiments, a DD of the DDpp specifically binds HER2. In further embodiments, the DD specifically binds HER2 having an amino acid sequence consisting of SEQ ID NO: 967. In some embodiments, the DDpp comprises an amino acid sequence selected from the group consisting of SEQ ID NO: 911-949, and 950. In other embodiments, the DDpp comprises a variant of an amino acid sequence selected from the group consisting of SEQ ID NO: 911-949, and 950.

In some embodiments, the HER2-binding DDpp comprises multiple target-binding domains that bind a single target (e.g., dimers, trimers, etc.). In some embodiments, the DDpp comprises 2, 3, 4, 5, or more than 5, DD that specifically bind HER2 and that have an amino acid sequence selected from the group consisting of SEQ ID NO: 911-949, and 950. In some embodiments, the DDpp comprises 2, 3, 4, 5, or more than 5, DD that have the same sequence. In some embodiments, the DDpp comprises 2, 3, 4, 5 or more than 5, DD that specifically bind to different epitopes of HER2 and that have an amino acid sequence selected from the group consisting of SEQ ID NO: 911-949, and 950. In some embodiments, the DDpp comprises a DD that specifically binds HER2 and further comprises 2, 3, 4, 5 or more than 5, additional different DDs or target-binding binding domains (e.g., scFvs) that specifically bind to HER2 or a different target antigen. In some embodiments, the DDpp comprises a DD that specifically binds HER2 (e.g., a DD having an amino acid sequence selected from the group consisting of SEQ ID NO: 911-949, and 950) and further comprises one or more additional DDs or other target-binding binding domains that bind one or more antigens expressed on the surface of a cancer cell. In some embodiments, the DDpp comprises a DD that specifically binds HER2 e.g., a DD having an amino acid sequence selected from the group consisting of SEQ ID NO: 911-949, and 950) and further comprises one or more additional DDs or other target-binding binding domains that bind one or more cancer antigens. In some embodiments, the DDpp comprises a DD that specifically binds HER2 (e.g., a DD having an amino acid sequence selected from the group consisting of SEQ ID NO: 911-949, and 950) and specifically binds 2, 3, 4, 5, or more than 5, different targets. In further embodiments, the DDpp comprises a DD that specifically binds HER2 (e.g., a DD having an amino acid sequence selected from the group consisting of SEQ ID NO: 911-949, and 950) and specifically binds 2, 3, 4, 5, or more than 5, different cancer antigens. In some embodiments, the DDpp comprises a DD that specifically binds HER2 (e.g., a DD having an amino acid sequence selected from the group consisting of SEQ ID NO: 911-949, and 950) and specifically binds 2, 3, 4, 5, or more than 5, different cancer antigens expressed on the surface of a cancer cell. In some embodiments, the DDpp comprises a DD that specifically binds HER2 (e.g., a DD having an amino acid sequence selected from the group consisting of SEQ ID NO: 911-949, and 950) and specifically binds 2, 3, 4, 5, or more than 5, cancer antigens expressed on the surface of different cancer cells.

In some embodiments, the DDpp comprises a variant of a HER2-binding DD disclosed herein (reference DD) that retains the ability to specifically bind HER2. In some embodiments, the sequence of the HER2-binding DD variant contains 1, 2, 3, 4, 5, 6, 7, 8, 9, or 10, 1-3, 1-5, or 1-10, conservative or non-conservative substitutions compared to a reference HER2-binding DD having an amino acid sequence selected from the group consisting of SEQ ID NO: 911-949, and 950. In some embodiments, the sequence of the HER2-binding DD variant contains 1, 2, 3, 4, 5, 6, 7, 8, 9, or 10, 1-3, 1-5, or 1-10, conservative substitutions compared to a reference HER2-binding DD having an amino acid sequence selected from the group consisting of SEQ ID NO: 911-949, and 950. In some embodiments, the sequence of the HER2-binding DD variant contains 1, 2, 3, 4, 5, 6, 7, 8, 9, or 10, 1-3, 1-5, or 1-10, non-conservative substitutions compared to a reference HER2-binding DD having an amino acid sequence selected from the group consisting of SEQ ID NO: 911-949, and 950.

In some embodiments, the sequence of the HER2-binding DD variant contains a total of 1, 2, 3, 4, 5, 6, 7, 8, 9, or 10, 1-3, 1-5, or 1-10, conservative or non-conservative substitutions in positions corresponding to amino acid residues 1-22, 29-46, and 52-72, of a reference HER2-binding DD having an amino acid sequence selected from the group consisting of SEQ ID NO: 911-949, and 950. In some embodiments, the sequence of the HER2-binding DD variant contains a total of 1, 2, 3, 4, 5, 6, 7, 8, 9, or 10, 1-3, 1-5, or 1-10, conservative substitutions in positions corresponding to amino acid residues 1-22, 29-46, and 52-72, of a reference HER2-DD having an amino acid sequence selected from the group consisting of SEQ ID NO: 911-949, and 950. In some embodiments, the sequence of the HER2-binding DD variant contains a total of 1, 2, 3, 4, 5, 6, 7, 8, 9, or 10, 1-3, 1-5, or 1-10, non-conservative substitutions in positions corresponding to amino acid residues 1-22, 29-46, and 52-72, of a reference HER2-binding DD having an amino acid sequence selected from the group consisting of SEQ ID NO: 911-949, and 950.

In some embodiments, the sequence of the HER2-binding DD variant contains a total of 1, 2, 3, 4, 5, 6, 7, 8, 9, or 10, 1-3, 1-5, or 1-10, conservative or non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference HER2-binding DD having an amino acid sequence selected from the group consisting of SEQ ID NO: 911-949, and 950. In some embodiments, the sequence of the HER2-binding DD variant contains a total of 1, 2, 3, 4, 5, 6, 7, 8, 9, or 10, 1-3, 1-5, or 1-10, conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 911-949, and 950. In some embodiments, the sequence of the HER2-binding DD variant contains a total of 1, 2, 3, 4, 5, 6, 7, 8, 9, or 10, 1-3, 1-5, or 1-10, non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 911-949, and 950.

In some embodiments, the disclosure provides HER2-binding DDpp that completely or partially (e.g., overlap with an epitope) block binding of a reference DD to HER2, wherein the reference DD has an amino acid sequence selected from SEQ ID NO: 911-949, and 950. In other embodiments, the disclosure provides HER2-binding DDpp that bind to the same epitope of HER2as a a reference DD consisting of an amino acid sequence selected from SEQ ID NO: 911-949, and 950.

In some embodiments, the DDpp is a fusion protein comprising a DD that specifically binds HER2. In some embodiments, a DD of the DDpp fusion protein specifically binds HER2 having an amino acid sequence consisting of SEQ ID NO: 967. In some embodiments, the DDpp comprises an amino acid sequence selected from the group consisting of SEQ ID NO: 911-949, and 950. In other embodiments, the DDpp comprises a variant of an amino acid sequence selected from the group consisting of SEQ ID NO: 911-949, and 950. In some embodiments, the DDpp fusion protein comprises a full-length antibody or a portion (fragment) of an antibody. In some embodiments, the DDpp fusion protein comprises a full length IgG antibody (e.g., IgG1, IgG2, IgG2, or IgG4). In further embodiments, the DDpp fusion protein comprises a full length antibody that specifically binds a cancer antigen. In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the HER2-binding DDpp is an Fc fusion protein.

In some embodiments, the DDpp is a fusion protein comprising a HER2-binding DD operably linked to a serum protein. In some embodiments, the HER2-binding DDpp fusion protein comprises an amino acid sequence selected from the group consisting of SEQ ID NO: 911-949, and 950. In other embodiments, the HER2-binding DDpp fusion protein comprises a variant of an amino acid sequence selected from the group consisting of SEQ ID NO: 911-949, and 950. In some embodiments, the HER2-binding DDpp fusion protein comprises all or a portion of human serum albumin. In some embodiments, the DDpp fusion protein comprises AFP (SEQ ID NO: 9), or a fragment thereof. In some embodiments, the HER2-binding DDpp fusion protein comprises AFP p26 (SEQ ID NO: 10), or a fragment thereof. In some embodiments, the HER2-binding DDpp fusion protein comprises a polypeptide having the sequence of SEQ ID NO: 10, 968, 969, 970, 971, 972, 973, or 974. In some embodiments, the DDpp fusion protein contains a fragment of a serum protein or an antigenic fragment of a serum protein (e.g., AFP, and AFP p26). In some embodiments, the DDpp fusion protein comprises a fragment consisting of 5-500, 5-400, 5-300, 5-200, 5-100, 5-50, 10-500, 10-400, 10-300, 10-200, 10-100, or 10-50 amino acids of a serum protein.

In some embodiments, the HER2-binding DDpp fusion protein comprises the extracellular domain of a receptor or a fragment thereof. In some embodiments, the DDpp fusion protein comprises a DD that comprises an amino acid sequence selected from the group consisting of SEQ ID NO: 911-949, and 950. In other embodiments, the HER2-binding DDpp fusion protein comprises a variant of an amino acid sequence selected from the group consisting of SEQ ID NO: 911-949, and 950. In further embodiments, the HER2-binding DDpp fusion protein comprises the extracellular domain of HER2 (SEQ ID NO: 967), or a fragment thereof. In some embodiments, the HER2-binding DDpp fusion protein comprises the extracellular domain of a receptor selected from the group consisting of: CD19, CD20, CD22, HVEM, BTLA, DR3, CD37; TSLPR, IL7R, and gp96, or a fragment thereof.

In some embodiments, the HER2-binding DDpp fusion protein contains a fragment consisting of 5-500, 5-400, 5-300, 5-200, 5-100, 5-50, 10-500, 10-400, 10-300, 10-200, 10-100, or 10-50 amino acids of an extracellular domain, of a cell surface receptor. In some embodiments, the DDpp fusion protein contains a fragment of an extracellular domain of BCMA (SEQ ID NO: 7). In some embodiments, the DDpp fusion protein contains a fragment of an extracellular domain of CD123 (SEQ ID NO: 8). In some embodiments, the DDpp fusion protein contains a fragment of an extracellular domain of CS1 (SEQ ID NO: 965). In some embodiments, the DDpp contains a fragment of an extracellular domain, of a receptor selected from the group consisting of: CD19, CD20, CD22, HVEM, BTLA, DR3, CD37; TSLPR, IL7R, and gp96.

In additional embodiments, the HER2-binding DDpp fusion protein comprises an intracellular protein (e.g., a nuclear protein) or a fragment thereof. In some embodiments, the DDpp fusion protein comprises a DD that comprises an amino acid sequence selected from the group consisting of SEQ ID NO: 911-949, and 950. In other embodiments, the HER2-binding DDpp fusion protein comprises a variant of an amino acid sequence selected from the group consisting of SEQ ID NO: 911-949, and 950. In some embodiments, the HER2-binding DDpp fusion protein comprises a fragment consisting of 5-500, 5-400, 5-300, 5-200, 5-100, 5-50, 10-500, 10-400, 10-300, 10-200, 10-100, or 10-50 amino acid residues of an intracellular protein (e.g., a nuclear protein).

AFP-Binding DDpp

In some embodiments, a DD of the DDpp specifically binds AFP or a fragment thereof. In further embodiments, a DD of the DDpp specifically binds AFP having an amino acid sequence consisting of SEQ ID NO: 9 or a fragment thereof. In some embodiments, the DDpp comprises an amino acid sequence selected from the group consisting of SEQ ID NO: 741-874, and 886-895. In additional embodiments, the AFP-binding DDpp comprises a variant of an amino acid sequence selected from the group consisting of SEQ ID NO: 741-874, and 886-895.

In some embodiments, the AFP-binding DDpp comprises multiple target-binding domains that bind a single target (e.g., dimers, trimers, etc.). In some embodiments, the DDpp comprises 2, 3, 4, 5, or more than 5, DD that specifically bind AFP and that have an amino acid sequence selected from the group consisting of SEQ ID NO: 741-874, and 886-895. In some embodiments, the DDpp comprises 2, 3, 4, 5, or more than 5, DD that have the same sequence. In some embodiments, the DDpp comprises 2, 3, 4, 5 or more than 5, DD that specifically bind to different epitopes of AFP and that have an amino acid sequence selected from the group consisting of SEQ ID NO: 741-874, and 886-895. In some embodiments, the DDpp comprises a DD that specifically binds AFP and further comprises 2, 3, 4, 5 or more than 5, additional different DDs or target-binding binding domains (e.g., scFvs) that specifically bind to AFP or a different target antigen. In some embodiments, the DDpp comprises a DD that specifically binds AFP (e.g., a DD having an amino acid sequence selected from the group consisting of SEQ ID NO: 741-874, and 886-895) and further comprises one or more additional DDs or other target-binding binding domains that bind one or more antigens expressed on the surface of a B cell. In some embodiments, the DDpp comprises a DD that specifically binds AFP e.g., a DD having an amino acid sequence selected from the group consisting of SEQ ID NO: 741-874, and 886-895) and further comprises one or more additional DDs or other target-binding binding domains that bind one or more cancer antigens. In some embodiments, the DDpp comprises a DD that specifically binds AFP (e.g., a DD having an amino acid sequence selected from the group consisting of SEQ ID NO: 741-874, and 886-895) and specifically binds 2, 3, 4, 5, or more than 5, different targets. In further embodiments, the DDpp comprises a DD that specifically binds AFP (e.g., a DD having an amino acid sequence selected from the group consisting of SEQ ID NO: 741-874, and 886-895) and specifically binds 2, 3, 4, 5, or more than 5, different cancer antigens. In some embodiments, the DDpp comprises a DD that specifically binds AFP (e.g., a DD having an amino acid sequence selected from the group consisting of SEQ ID NO: 741-874, and 886-895) and specifically binds 2, 3, 4, 5, or more than 5, different cancer antigens expressed on the surface of a cancer cell. In some embodiments, the DDpp comprises a DD that specifically binds AFP (e.g., a DD having an amino acid sequence selected from the group consisting of SEQ ID NO: 741-874, and 886-895) and specifically binds 2, 3, 4, 5, or more than 5, cancer antigens expressed on the surface of different cancer cells.

In some embodiments, the DDpp comprises a variant of a AFP-binding DD disclosed herein (reference DD) that retains the ability to specifically bind AFP. In some embodiments, the sequence of the AFP-binding DD variant contains 1, 2, 3, 4, 5, 6, 7, 8, 9, or 10, 1-3, 1-5, or 1-10, conservative or non-conservative substitutions compared to a reference AFP-binding DD having an amino acid sequence selected from the group consisting of SEQ ID NO: 741-874, and 886-895. In some embodiments, the sequence of the AFP-binding DD variant contains 1, 2, 3, 4, 5, 6, 7, 8, 9, or 10, 1-3, 1-5, or 1-10, conservative substitutions compared to a reference AFP-binding DD having an amino acid sequence selected from the group consisting of SEQ ID NO: 741-874, and 886-895. In some embodiments, the sequence of the AFP-binding DD variant contains 1, 2, 3, 4, 5, 6, 7, 8, 9, or 10, 1-3, 1-5, or 1-10, non-conservative substitutions compared to a reference AFP-binding DD having an amino acid sequence selected from the group consisting of SEQ ID NO: 741-874, and 886-895.

In some embodiments, the sequence of the AFP-binding DD variant contains a total of 1, 2, 3, 4, 5, 6, 7, 8, 9, or 10, 1-3, 1-5, or 1-10, conservative or non-conservative substitutions in positions corresponding to amino acid residues 1-22, 29-46, and 52-72, of a reference AFP-binding DD having an amino acid sequence selected from the group consisting of SEQ ID NO: 4741-874, and 886-895. In some embodiments, the sequence of the AFP-binding DD variant contains a total of 1, 2, 3, 4, 5, 6, 7, 8, 9, or 10, 1-3, 1-5, or 1-10, conservative substitutions in positions corresponding to amino acid residues 1-22, 29-46, and 52-72, of a reference AFP-DD having an amino acid sequence selected from the group consisting of SEQ ID NO: 741-874, and 886-895. In some embodiments, the sequence of the AFP-binding DD variant contains a total of 1, 2, 3, 4, 5, 6, 7, 8, 9, or 10, 1-3, 1-5, or 1-10, non-conservative substitutions in positions corresponding to amino acid residues 1-22, 29-46, and 52-72, of a reference AFP-binding DD having an amino acid sequence selected from the group consisting of SEQ ID NO: 741-874, and 886-895.

In some embodiments, the sequence of the AFP-binding DD variant contains a total of 1, 2, 3, 4, 5, 6, 7, 8, 9, or 10, 1-3, 1-5, or 1-10, conservative or non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference AFP-binding DD having an amino acid sequence selected from the group consisting of SEQ ID NO: 741-874, and 886-895. In some embodiments, the sequence of the AFP-binding DD variant contains a total of 1, 2, 3, 4, 5, 6, 7, 8, 9, or 10, 1-3, 1-5, or 1-10, conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 741-874, and 886-895. In some embodiments, the sequence of the AFP-binding DD variant contains a total of 1, 2, 3, 4, 5, 6, 7, 8, 9, or 10, 1-3, 1-5, or 1-10, non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 741-874, and 886-895.

In some embodiments, the disclosure provides an AFP-binding DDpp that completely or partially (e.g., overlap with an epitope) block binding of a reference DD to AFP, wherein the reference DD has an amino acid sequence selected from SEQ ID NO: 741 873, and 874. In other embodiments, the disclosure provides AFP-binding DDpp that bind to the same epitope of AFP as a a reference DD consisting of an amino acid sequence selected from SEQ ID NO: 741 873, and 874.

In some embodiments, the DDpp is a fusion protein comprising a DD that specifically binds AFP. In some embodiments, the DDpp is a fusion protein comprising a DD that specifically binds AFP having an amino acid sequence consisting of SEQ ID NO: 9. In further embodiments, the DDpp comprises an amino acid sequence selected from the group consisting of SEQ ID NO: 741-874, and 886-895. In other embodiments, the DDpp is a fusion protein comprising a AFP-binding DD that is a variant of a DD comprising an amino acid sequence selected from the group consisting of SEQ ID NO: 741-874, and 886-895.

In some embodiments, the DDpp is a fusion protein comprising a DD that specifically binds AFP operably linked to a full-length antibody or a portion (fragment) of an antibody. In some embodiments, the DDpp is an Fc fusion protein. In some embodiment, the DDpp fusion protein comprises a full length IgG antibody (e.g., IgG1, IgG2, IgG2, or IgG4). In further embodiments, the DDpp fusion protein comprises a full length antibody that specifically binds a cancer antigen. In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the AFP-binding DDpp is an Fc fusion protein.

In some embodiments, the DDpp is a fusion protein comprising an AFP-binding DD operably linked to a serum protein. In some embodiments, the DDpp fusion protein comprises an amino acid sequence selected from the group consisting of SEQ ID NO: 741-874, and 886-895. In other embodiments, the AFP-binding DDpp fusion protein comprises a variant of an amino acid sequence selected from the group consisting of SEQ ID NO: 741-874, and 886-895. In further embodiments, the DDpp fusion protein comprises human serum albumin or a fragment thereof. In some embodiments, the DDpp fusion protein contains a fragment of a serum protein or an antigenic fragment of a serum protein. In some embodiments, the DDpp fusion protein comprises a fragment consisting of 5-500, 5-400, 5-300, 5-200, 5-100, 5-50, 10-500, 10-400, 10-300, 10-200, 10-100, or 10-50 amino acids of a serum protein.

In some embodiments, the AFP-binding DDpp fusion protein comprises the extracellular domain of a receptor or a fragment thereof. In some embodiments, the DDpp fusion protein comprises a DD that comprises an amino acid sequence selected from the group consisting of SEQ ID NO: 741-874, and 886-895. In other embodiments, the AFP-binding DDpp fusion protein comprises a variant of an amino acid sequence selected from the group consisting of SEQ ID NO: 741-874, and 886-895. In further embodiments, the AFP-binding DDpp fusion protein comprises the extracellular domain of BCMA (SEQ ID NO: 7) or CD123 (SEQ ID NO: 8), or a fragment thereof. In further embodiments, the AFP-binding DDpp fusion protein comprises the extracellular domain of BCMA (SEQ ID NO: 7), CD123 (SEQ ID NO: 8), or CS1 (SEQ ID NO: 965), or a fragment thereof. In some embodiments, the AFP-binding DDpp fusion protein comprises the extracellular domain of of a receptor selected from the group consisting of: CD19, CD20, CD22, HVEM, BTLA, DR3, CD37; TSLPR, IL7R, and gp96, or a fragment thereof.

In some embodiments, the AFP-binding DDpp fusion protein contains a fragment consisting of 5-500, 5-400, 5-300, 5-200, 5-100, 5-50, 10-500, 10-400, 10-300, 10-200, 10-100, or 10-50 amino acids of an extracellular domain, of a cell surface receptor. In some embodiments, the DDpp fusion protein contains a fragment of an extracellular domain of BCMA (SEQ ID NO: 7) or CD123 (SEQ ID NO: 8). In some embodiments, the DDpp fusion protein contains a fragment of an extracellular domain of BCMA (SEQ ID NO: 7), or CD123 (SEQ ID NO: 8), or CS1 (SEQ ID NO: 965). In some embodiments, the DDpp contains a fragment of an extracellular domain, of a receptor selected from the group consisting of: CD19, CD20, CD22, HVEM, BTLA, DR3, CD37; TSLPR, IL7R, and gp96.

In additional embodiments, the AFP-binding DDpp fusion protein comprises an intracellular protein (e.g., a nuclear protein) or a fragment thereof. In some embodiments, the DDpp fusion protein comprises a DD that comprises an amino acid sequence selected from the group consisting of SEQ ID NO: 741-874, and 886-895. In other embodiments, the AFP-binding DDpp fusion protein comprises a variant of an amino acid sequence selected from the group consisting of SEQ ID NO: 741-874, and 886-895. In some embodiments, the AFP-binding DDpp fusion protein comprises a fragment consisting of 5-500, 5-400, 5-300, 5-200, 5-100, 5-50, 10-500, 10-400, 10-300, 10-200, 10-100, or 10-50 amino acid residues of an intracellular protein (e.g., a nuclear protein).

AFP p26-Binding DDpp

In some embodiments, a DD of the DDpp specifically binds AFP p26. In further embodiments, a DD of the DDpp specifically binds AFP p26 having an amino acid sequence consisting of SEQ ID NO: 10. In some embodiments, the DDpp comprises an amino acid sequence selected from the group consisting of SEQ ID NO: 741-874, and 886-895. In additional embodiments, the AFP p26-binding DDpp comprises a variant of an amino acid sequence selected from the group consisting of SEQ ID NO: 741-874, and 886-895.

In some embodiments, the AFP p26-binding DDpp comprises multiple target-binding domains that bind a single target (e.g., dimers, trimers, etc.). In some embodiments, the DDpp comprises 2, 3, 4, 5, or more than 5, DD that specifically bind AFP p26 and that have an amino acid sequence selected from the group consisting of SEQ ID NO: 741-874, and 886-895. In some embodiments, the DDpp comprises 2, 3, 4, 5, or more than 5, DD that have the same sequence. In some embodiments, the DDpp comprises 2, 3, 4, 5 or more than 5, DD that specifically bind to different epitopes of AFP p26 and that have an amino acid sequence selected from the group consisting of SEQ ID NO: 741-874, and 886-895. In some embodiments, the DDpp comprises a DD that specifically binds AFP p26 and further comprises 2, 3, 4, 5 or more than 5, additional different DDs or target-binding binding domains (e.g., scFvs) that specifically bind to AFP p26 or a different target antigen. In some embodiments, the DDpp comprises a DD that specifically binds AFP p26 (e.g., a DD having an amino acid sequence selected from the group consisting of SEQ ID NO: 741-874, and 886-895) and further comprises one or more additional DDs or other target-binding binding domains that bind one or more antigens expressed on the surface of a B cell. In some embodiments, the DDpp comprises a DD that specifically binds AFP p26 e.g., a DD having an amino acid sequence selected from the group consisting of SEQ ID NO: 741-874, and 886-895) and further comprises one or more additional DDs or other target-binding binding domains that bind one or more cancer antigens. In some embodiments, the DDpp comprises a DD that specifically binds AFP p26 (e.g., a DD having an amino acid sequence selected from the group consisting of SEQ ID NO: 741-874, and 886-895) and specifically binds 2, 3, 4, 5, or more than 5, different targets. In further embodiments, the DDpp comprises a DD that specifically binds AFP p26 (e.g., a DD having an amino acid sequence selected from the group consisting of SEQ ID NO: 741-874, and 886-895) and specifically binds 2, 3, 4, 5, or more than 5, different cancer antigens. In some embodiments, the DDpp comprises a DD that specifically binds AFP p26 (e.g., a DD having an amino acid sequence selected from the group consisting of SEQ ID NO: 741-874, and 886-895) and specifically binds 2, 3, 4, 5, or more than 5, different cancer antigens expressed on the surface of a cancer cell. In some embodiments, the DDpp comprises a DD that specifically binds AFP p26 (e.g., a DD having an amino acid sequence selected from the group consisting of SEQ ID NO: 741-874, and 886-895) and specifically binds 2, 3, 4, 5, or more than 5, cancer antigens expressed on the surface of different cancer cells.

In some embodiments, the DDpp comprises a variant of a AFP p26-binding DD disclosed herein (reference DD) that retains the ability to specifically bind AFP p26. In some embodiments, the sequence of the AFP p26-binding DD variant contains 1, 2, 3, 4, 5, 6, 7, 8, 9, or 10, 1-3, 1-5, or 1-10, conservative or non-conservative substitutions compared to a reference AFP p26-binding DD having an amino acid sequence selected from the group consisting of SEQ ID NO: 741-874, and 886-895. In some embodiments, the sequence of the AFP p26-binding DD variant contains 1, 2, 3, 4, 5, 6, 7, 8, 9, or 10, 1-3, 1-5, or 1-10, conservative substitutions compared to a reference AFP p26-binding DD having an amino acid sequence selected from the group consisting of SEQ ID NO: 741-874, and 886-895. In some embodiments, the sequence of the AFP p26-binding DD variant contains 1, 2, 3, 4, 5, 6, 7, 8, 9, or 10, 1-3, 1-5, or 1-10, non-conservative substitutions compared to a reference AFP p26-binding DD having an amino acid sequence selected from the group consisting of SEQ ID NO: 741-874, and 886-895.

In some embodiments, the sequence of the AFP p26-binding DD variant contains a total of 1, 2, 3, 4, 5, 6, 7, 8, 9, or 10, 1-3, 1-5, or 1-10, conservative or non-conservative substitutions in positions corresponding to amino acid residues 1-22, 29-46, and 52-72, of a reference AFP p26-binding DD having an amino acid sequence selected from the group consisting of SEQ ID NO: 4741-874, and 886-895. In some embodiments, the sequence of the AFP p26-binding DD variant contains a total of 1, 2, 3, 4, 5, 6, 7, 8, 9, or 10, 1-3, 1-5, or 1-10, conservative substitutions in positions corresponding to amino acid residues 1-22, 29-46, and 52-72, of a reference AFP p26-DD having an amino acid sequence selected from the group consisting of SEQ ID NO: 741-874, and 886-895. In some embodiments, the sequence of the AFP p26-binding DD variant contains a total of 1, 2, 3, 4, 5, 6, 7, 8, 9, or 10, 1-3, 1-5, or 1-10, non-conservative substitutions in positions corresponding to amino acid residues 1-22, 29-46, and 52-72, of a reference AFP p26-binding DD having an amino acid sequence selected from the group consisting of SEQ ID NO: 741-874, and 886-895.

In some embodiments, the sequence of the AFP p26-binding DD variant contains a total of 1, 2, 3, 4, 5, 6, 7, 8, 9, or 10, 1-3, 1-5, or 1-10, conservative or non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference AFP p26-binding DD having an amino acid sequence selected from the group consisting of SEQ ID NO: 741-874, and 886-895. In some embodiments, the sequence of the AFP p26-binding DD variant contains a total of 1, 2, 3, 4, 5, 6, 7, 8, 9, or 10, 1-3, 1-5, or 1-10, conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 741-874, and 886-895. In some embodiments, the sequence of the AFP p26-binding DD variant contains a total of 1, 2, 3, 4, 5, 6, 7, 8, 9, or 10, 1-3, 1-5, or 1-10, non-conservative substitutions in positions corresponding to amino acid residues: 2-6, 8-10, 12, 13, 15-17, 19, 20, 29, 30, 32-34, 36, 37, 39-41, 43, 44, 52-55, 57-59, 61, 62, 64-66, and 68-70, of a reference DD having an amino acid sequence selected from the group consisting of SEQ ID NO: 741-874, and 886-895.

In some embodiments, the disclosure provides an AFP p26-binding DDpp that completely or partially (e.g., overlap with an epitope) block binding of a reference DD to AFP p26, wherein the reference DD has an amino acid sequence selected from SEQ ID NO: 741 873, and 874. In other embodiments, the disclosure provides AFP p26-binding DDpp that bind to the same epitope of AFP p26 as a a reference DD consisting of an amino acid sequence selected from SEQ ID NO: 741 873, and 874.

In some embodiments, the DDpp is a fusion protein comprising a DD that specifically binds AFP p26. In some embodiments, the DDpp is a fusion protein comprising a DD that specifically binds AFP p26 having an amino acid sequence consisting of SEQ ID NO: 9. In further embodiments, the DDpp comprises an amino acid sequence selected from the group consisting of SEQ ID NO: 741-874, and 886-895. In other embodiments, the DDpp is a fusion protein comprising a AFP p26-binding DD that is a variant of a DD comprising an amino acid sequence selected from the group consisting of SEQ ID NO: 741-874, and 886-895. In some embodiments, the DDpp is a fusion protein comprising a DD that specifically binds AFP p26 operably linked to a full-length antibody or a portion (fragment) of an antibody. In some embodiments, the DDpp is an Fc fusion protein. In some embodiment, the DDpp fusion protein comprises a full length IgG antibody (e.g., IgG1, IgG2, IgG2, or IgG4). In further embodiments, the DDpp fusion protein comprises a full length antibody that specifically binds a cancer antigen. In further embodiments, the DDpp comprises a commercially approved therapeutic antibody (e.g., rituximab, ofatumumab, ocrelizumab, veltuzumab, MEDI-551, epratuzumab, belimumab, tabalumab, AMG-557, MEDI-570, and NN882). In other embodiments, the AFP p26-binding DDpp is an Fc fusion protein. In further embodiments, the Fc fusion protein comprises a variant human Fc domain.

In some embodiments, the DDpp is a fusion protein comprising an AFP p26-binding DD operably linked to a serum protein. In some embodiments, the DDpp fusion protein comprises an amino acid sequence selected from the group consisting of SEQ ID NO: 741-874, and 886-895. In other embodiments, the AFP p26-binding DDpp fusion protein comprises a variant of an amino acid sequence selected from the group consisting of SEQ ID NO: 741-874, and 886-895. In further embodiments, the DDpp fusion protein comprises human serum albumin or a fragment thereof. In some embodiments, the DDpp fusion protein contains a fragment of a serum protein or an antigenic fragment of a serum protein. In some embodiments, the DDpp fusion protein comprises a fragment consisting of 5-500, 5-400, 5-300, 5-200, 5-100, 5-50, 10-500, 10-400, 10-300, 10-200, 10-100, or 10-50 amino acids of a serum protein.

In some embodiments, the AFP p26-binding DDpp fusion protein comprises the extracellular domain of a receptor or a fragment thereof. In some embodiments, the DDpp fusion protein comprises a DD that comprises an amino acid sequence selected from the group consisting of SEQ ID NO: 741-874, and 886-895. In other embodiments, the AFP p26-binding DDpp fusion protein comprises a variant of an amino acid sequence selected from the group consisting of SEQ ID NO: 741-874, and 886-895. In further embodiments, the AFP p26-binding DDpp fusion protein comprises the extracellular domain of BCMA (SEQ ID NO: 7) or CD123 (SEQ ID NO: 8), or a fragment thereof. In further embodiments, the AFP p26-binding DDpp fusion protein comprises the extracellular domain of BCMA (SEQ ID NO: 7), or CD123 (SEQ ID NO: 8), or CS1 (SEQ ID NO: 965), or a fragment thereof. In some embodiments, the AFP p26-binding DDpp fusion protein comprises the extracellular domain of of a receptor selected from the group consisting of: CD19, CD20, CD22, HVEM, BTLA, DR3, CD37; TSLPR, IL7R, and gp96, or a fragment thereof.

In some embodiments, the AFP p26-binding DDpp fusion protein contains a fragment consisting of 5-500, 5-400, 5-300, 5-200, 5-100, 5-50, 10-500, 10-400, 10-300, 10-200, 10-100, or 10-50 amino acids of an extracellular domain, of a cell surface receptor. In some embodiments, the DDpp fusion protein contains a fragment of an extracellular domain of BCMA (SEQ ID NO: 7) or CD123 (SEQ ID NO: 8). In some embodiments, the DDpp fusion protein contains a fragment of an extracellular domain of BCMA (SEQ ID NO: 7), or CD123 (SEQ ID NO: 8), or CS1 (SEQ ID NO: 965). In some embodiments, the DDpp contains a fragment of an extracellular domain, of a receptor selected from the group consisting of: CD19, CD20, CD22, HVEM, BTLA, DR3, CD37; TSLPR, IL7R, and gp96.

In additional embodiments, the AFP p26-binding DDpp fusion protein comprises an intracellular protein (e.g., a nuclear protein) or a fragment thereof. In some embodiments, the DDpp fusion protein comprises a DD that comprises an amino acid sequence selected from the group consisting of SEQ ID NO: 741-874, and 886-895. In other embodiments, the AFP p26-binding DDpp fusion protein comprises a variant of an amino acid sequence selected from the group consisting of SEQ ID NO: 741-874, and 886-895. In some embodiments, the AFP p26-binding DDpp fusion protein comprises a fragment consisting of 5-500, 5-400, 5-300, 5-200, 5-100, 5-50, 10-500, 10-400, 10-300, 10-200, 10-100, or 10-50 amino acid residues of an intracellular protein (e.g., a nuclear protein).

Nucleic acids encoding the DDpp and vectors containing the nucleic acids are also provided. Host cells (including viral particles) containing the nucleic acids and vectors are also provided. In some embodiments, the host cell is a prokaryote or a eukaryote that display the variant DD on its surface. In some embodiments, the host cell displays the variant DD on its surface. In a further embodiment, the host cell is a phage that displays the variant DD on its surface. In a further embodiment, the host cell is a human immune cell that expresses a variant DD fusion protein on its surface.

A DDpp agonist refers to a DDpp that in some way increases or enhances the biological activity of the DDpp target or has biological activity comparable to a known agonist of the DDpp target. In another embodiment, the DDpp is an antagonist of the target it binds. A DDpp antagonist refers to a DDpp that completely or partially blocks or in some way interferes with the biological activity of the DDpp target protein or has biological activity comparable to a known antagonist or inhibitor of the DDpp target protein.

Expressions like "binding affinity for a target", "binding to a target" and the like refer to a property of a polypeptide which may be directly measured through the determination of the affinity constants, e.g., the amount of DDpp that associates and dissociates at a given antigen concentration. Different methods can be used to characterize the molecular interaction, including but not limited to, competition analysis, equilibrium analysis and microcalorimetric analysis, and real-time interaction analysis based on surface plasmon resonance interaction (for example using a Biacore® instrument). These methods are known to the skilled person and are described, for example, in Neri et al., Tibtech 14: 465-470 (1996) and Jansson et al., J Biol Chem 272: 8189-8197 (1997).

Affinity requirements for a given DDpp binding event are contingent on a variety of factors including, but not limited to: the composition and complexity of the binding matrix, the valency and density of both the DDpp and target molecules, and the functional application of the DDpp. In one embodiment, DDpp bind a target of interest (e.g., BCMA, CD123, AFP, or AFP p26) with a dissociation constant (KD) of less than or equal to $5\times10^{-3}$ M, $10^{-3}$ M, $5\times10^{-4}$ M, $10^{-4}$ M, $5\times10^{-5}$ M, or $10^{-5}$ M. In an additional embodiment, a DDpp binds a target of interest with a KD of less than or equal to $5\times10^{-6}$ M, $10^{-6}$ M, $5\times10^{-7}$ M, $10^{-7}$M, $5\times10^{-8}$ M, or $10^{-8}$ M. In additional embodiments, a DDpp binds a target of interest with a KD of less than or equal to $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, $10^{-13}$ M, $5\times10^{-14}$ M, $10^{-14}$ M, $5\times10-15$ M, or $10^{-15}$ M. In some embodiments, the provided DDpp has a dissociation constant selected from the group consisting of between $10^{-4}$ M and $10^{-5}$ M, between $10^{-5}$ M and $10^{-6}$ M, between $10^{-6}$ M and $10^{-7}$ M, between $10^{-7}$ M and $10^{-8}$ M, between $10^{-8}$ M and $10^{-9}$ M, between $10^{-9}$ M and $10^{-10}$ M, between $10^{-10}$ M and $10^{-11}$ M and between $10^{-11}$ M and $10^{-12}$ M.

In some embodiments, the DDpp binds a target of interest (e.g., BCMA, CD123, AFP, or AFP p26) in active form. In one embodiment the DDpp reversibly binds the target of interest in active form and also releases the bound target in active form. In some embodiments, the DDpp binds a target of interest in the native form. In specific embodiments, DDpp binds a target of interest with an off-rates or $K_{off}$ of greater than or equal to $10^{-10}$ sec$^{-1}$, $5\times10^{-9}$ sec$^{-1}$, $10^{-9}$ sec$^{-1}$, $5\times10^{-8}$ sec$^{-1}$, $10^{-8}$ sec$^{-1}$, $5\times10^{-7}$ sec$^{-1}$, $10^{-7}$ sec$^{-1}$, $5\times10^{-6}$ sec$^{-1}$, $10^{-6}$ sec$^{-1}$, $5\times10^{-5}$ sec$^{-1}$, $10^{-5}$ sec$^{-1}$, $5\times10^{-4}$ sec$^{-1}$, $10^{-4}$ sec$^{-1}$, $5\times10^{-3}$ sec$^{-1}$, $10^{-3}$ sec$^{-1}$, $5\times10^{-2}$ sec$^{-1}$, $10^{-2}$ sec$^{-1}$, $5\times10^{-1}$ sec$^{-1}$, or $10^{-1}$ sec$^{-1}$.

Binding experiments to determine KD and off-rates can routinely be performed in a number of conditions including, but not limited to, [pH 6.0, 0.01% Tween 2, [pH 6.0, 0.1% gelatin], [p H5.0, 0.01% Tween 2, [pH 9.0, 0.1% Tween 2, [pH 6.0, 15% ethylene glycol, 0.01% Tween 2, [pH 5.0, 15% ethylene glycol, 0.01% Tween 2, and [pH 9.0, 15% ethylene glycol, 0.01% Tween 2. The buffers in which to make these solutions can routinely be determined by one skilled in the art, and depend largely on the desired pH of the final solution. Low pH solutions (<pH 5.5) can be made, for example, in citrate buffer, glycine-HCl buffer, or in succinic acid buffer. High pH solutions can be made, for example, in Tris-HCl, phosphate buffers, or sodium bicarbonate buffers. A number of conditions may routinely be used by those skilled in the art to determine KD and off-rates for the purpose of determining, for example, optimal pH and/or salt concentrations.

In one embodiment, the DDpp specifically binds a target of interest (e.g., BCMA, CD123, AFP, or AFP p26) with a $K_{off}$ ranging from 0.1 to $10^{-7}$ $sec^{-1}$, $10^{-2}$ to $10^{-7}$ $sec^{-1}$, or $0.5 \times 10^{-2}$ to $10^{-7}$ $sec^{-1}$. In a specific embodiment, the DDpp (e.g., a DDpp fusion protein) binds a target of interest with an off rate ($K_{off}$) of less than $5 \times 10^{-2}$ $sec^{-1}$, $10^{-2}$ $sec^{-1}$, $5 \times 10^{-3}$ $sec^{-1}$, or $10^{-3}$ $sec^{-1}$. In an additional embodiment, a DDpp, binds a target of interest with an off rate ($K_{Off}$) of less than $5 \times 10$ $sec^{-1}$, $10$ $sec^{-1}$, $5 \times 10^{-5}$ $sec^{-1}$, or $10^{-5}$ $sec^{-1}$, $5 \times 10^{-6}$ $sec^{-1}$, $10^{-6}$ $sec^{-1}$, $5 \times 10^{-7}$ $sec^{-1}$, or $10^{-7}$ $sec^{-1}$.

In one embodiment, the DDpp specifically binds a target of interest (e.g., BCMA, CD123, AFP, or AFP p26) with a $K_{On}$ ranging from $10^3$ to $10^7$ $M^{-1}$ $sec^{-1}$, $10^3$ to $10^6$ $M^{-1}$ $sec^{-1}$, or $10^3$ to $10^5$ $M^{-1}$ $sec^{-1}$. In a specific embodiment, the DDpp (e.g., a DDpp fusion protein) binds the target of interest with an on rate ($R_{On}$) of greater than $10^3$ $M^{-1}$ $sec^{-1}$, $5 \times 10^3$ $M^{-1}$ $sec^{-1}$, $10^4$ $M^{-1}$ $sec^{-1}$, or $5 \times 10^4$ $M^{-1}$ $sec^{-1}$. In an additional embodiment, the DDpp, binds the target of interest with a $K_{On}$ of greater than $10^5$ $M^{-1}$ $sec^{-1}$, $5 \times 10^5$ $M^{-1}$ $sec^{-1}$, $10^6$ $M^{-1}$ $sec^{-1}$, or $5 \times 10^6$ $M^{-1}$ $sec^{-1}$, or $10^7$ $M^{-1}$ $sec^{-1}$.

Nucleic acid molecules encoding the disclosed DDpp are encompassed herein, as are vectors containing these nucleic acids, host cells containing these nucleic acids vectors, and methods of making the DDpp-albumin fusion proteins and using these nucleic acids, vectors, and/or host cells. The invention also encompasses pharmaceutical formulations comprising a DDpp-albumin fusion protein and a pharmaceutically acceptable diluent or carrier. Such formulations can be used in methods of treating, preventing, ameliorating or diagnosing a disease or disease symptom in a patient, preferably a mammal, most preferably a human, comprising the step of administering the pharmaceutical formulation to the patient.

Production of DDpp

The disclosed DDpp can routinely be made using commercially available reagents and techniques known in the art. In one embodiment, the DDpp are synthesized by solid phase synthesis techniques known in the art, such as, Merrifield, J. Am. Chem. Soc. 85: 2149 (1963); Davis et al., Biochem. Intl. 10: 394-414 (1985); Larsen et al., J. Am. Chem. Soc. 115: 6247 (1993); Smith et al., J. Peptide Protein Res. 44: 183 (1994); O'Donnell et al., J. Am. Chem. Soc. 118: 6070 (1996); Stewart and Young, Solid Phase Peptide Synthesis, Freeman (1969); Finn et al., The Proteins, 3.sup.rd ed., 2: 105-253 (1976); and Erickson et al., The Proteins, 3.sup.rd ed., 2: 257-527 (1976). The disclosure contemplates synthetic peptides. Alternatively, the peptide is expressed recombinantly by introducing a nucleic acid encoding the disclosed DDpp into host cells, which are cultured to express the peptide. Such peptides are purified from the culture media or cell pellets.

The production of the DDpp, useful in practicing the provided methods, may be carried out using a variety of standard techniques for chemical synthesis, semi-synthetic methods, and recombinant DNA methodologies known in the art. Also provided is a method for producing a DDpp, individually or as part of multi-domain fusion protein, as soluble agents and cell associated proteins.

Optionally, the reference sequence and/or the modified polypeptides (e.g., DDpp) can be de-immunized. For example, residues or motifs that are potentially immunogenic can be identified and modified in order to reduce or eliminate potential immune responses to the DDpp. Additional details regarding various embodiments, of the production, selection, and isolation of DDpp are provided in more detail below.

Recombinant Expression of DDpp

In some embodiments, a DDpp such as a DDpp fusion protein is "recombinantly produced," (i.e., produced using recombinant DNA technology). Exemplary recombinant methods available for synthesizing DDpp fusion proteins, include, but are not limited to polymerase chain reaction (PCR) based synthesis, concatemerization, seamless cloning, and recursive directional ligation (RDL) (see, e.g., Meyer et al., Biomacromolecules 3: 357-367 (2002); Kurihara et al., Biotechnol. Lett. 27: 665-670 (2005); Haider et al., Mol. Pharm. 2: 139-150 (2005); and McMillan et al., 32: 3643-3646 (1999); the contents of each of which is herein incorporated by reference in its entirety).

Nucleic acids comprising a polynucleotide sequence encoding a DDpp are also provided. Such polynucleotides optionally further comprise, one or more expression control elements. For example, the polynucleotide can comprise one or more promoters or transcriptional enhancers, ribosomal binding sites, transcription termination signals, and polyadenylation signals, as expression control elements. The polynucleotide can be inserted within any suitable vector, which can be contained within any suitable host cell for expression.

The expression of nucleic acids encoding DDpp is typically achieved by operably linking a nucleic acid encoding the DDpp to a promoter in an expression vector. Typical expression vectors contain transcription and translation terminators, initiation sequences, and promoters useful for regulation of the expression of the desired nucleic acid sequence. Methods known in the art can be used to routinely construct expression vectors containing the nucleic acid sequence encoding a DDpp along with appropriate transcriptional/translational control signals. These methods include, but are not limited to in vitro recombinant DNA techniques, synthetic techniques and in vivo recombination/genetic recombination. The expression of the polynucleotide can be performed in any suitable expression host known in the art including, but not limited to bacterial cells, yeast cells, insect cells, plant cells or mammalian cells. In one embodiment, a nucleic acid sequence encoding a DDpp is operably linked to a suitable promoter sequence such that the nucleic acid sequence is transcribed and/or translated into DDpp in a host. Promoters useful for expression in E. coli, include but are not limited to, the T7 promoter.

In one embodiment, a vector comprising a DDpp encoding nucleic acid is introduced into a host cell (e.g., phagemid) for expression of a DDpp. The vector can remain episomal or become chromosomally integrated, as long as the insert encoding therapeutic agent can be transcribed. Vectors can be constructed by standard recombinant DNA technology. Vectors can be plasmids, phages, cosmids, phagemids, viruses, or any other types known in the art, which are used for replication and expression in prokaryotic or eukaryotic cells. It will be appreciated by one of skill in the art that a wide variety of components known in the art (such as expression control elements) can be included in such vectors, including a wide variety of transcription signals, such as promoters and other sequences that regulate the binding of RNA polymerase onto the promoter. Any promoter known or demonstrated to be effective in the cells in which the vector will be expressed can be used to initiate expression of the DDpp. Suitable promoters can be inducible (e.g., regulated) or constitutive. Non-limiting examples of suitable promoters include the SV40 early promoter region, the promoter contained in the 3' long terminal repeat of Rous sarcoma virus, the HSV-1 (herpes simplex virus-1) thymidine kinase promoter, the regulatory sequences of the metallothionein gene, etc., as well as the following animal transcriptional control regions, which exhibit tissue specificity and have been utilized in transgenic animals: elastase I gene control region which is active in pancreatic acinar cells; insulin gene control region which is active in pancreatic beta cells, mouse mammary tumor virus control region which is active in testicular, breast, lymphoid and mast cells, albumin gene control region which is active in liver, alpha-fetoprotein gene control region which is active in liver, alpha 1-antitrypsin gene control region which is active in the liver, beta-globin gene control region which is active in erythroid cells, myelin basic protein gene control region which is active in oligodendrocyte cells in the brain, myosin light chain-2 gene control region which is active in skeletal muscle, and gonadotropin releasing hormone gene control region which is active in the hypothalamus. In a particular embodiment, the promoter is an immunoglobulin gene control region which is active in lymphoid cells.

In one embodiment, one or several nucleic acids encoding a DDpp is expressed under the control of a constitutive promoter or, alternately, a regulated expression system. Suitable regulated expression systems include, but are not limited to, a tetracycline-regulated expression system, an ecdysone inducible expression system, a lac-switch expression system, a glucocorticoid-inducible expression system, a temperature-inducible promoter system, and a metallothionein metal-inducible expression system. If several different nucleic acids encoding a DDpp are contained within the host cell system, some of the nucleic acids may be expressed under the control of a constitutive promoter, while others may be expressed under the control of a regulated promoter. Expression levels may be determined by methods known in the art, including Western blot analysis and Northern blot analysis.

A variety of host-expression vector systems can be utilized to express a nucleic acid encoding a DDpp. Vectors containing the nucleic acids encoding the DDpp (e.g., individual DD subunits or DDpp fusions) or portions or fragments thereof, include plasmid vectors, a single and double-stranded phage vectors, as well as single and double-stranded RNA or DNA viral vectors. Phage and viral vectors may also be introduced into host cells in the form of packaged or encapsulated virus using known techniques for infection and transduction. Moreover, viral vectors may be replication competent or alternatively, replication defective. Alternatively, cell-free translation systems may also be used to produce the protein using RNAs derived from the DNA expression constructs (see, e.g., WO86/05807 and WO89/01036; and U.S. Pat. No. 5,122,464; the contents of each of which is herein incorporated by reference in its entirety).

Generally, any type of cells or cultured cell line can be used to express a DDpp provided herein. In some embodiments, the background cell line used to generate an engineered host cells is a phage, a bacterial cell, a yeast cell or a mammalian cell. A variety of host-expression vector systems may be used to express the coding sequence a DDpp fusion protein. Mammalian cells can be used as host cell systems transfected with recombinant plasmid DNA or cosmid DNA expression vectors containing the coding sequence of the target of interest and the coding sequence of the fusion polypeptide.

The cells can be primary isolates from organisms (including human), cultures, or cell lines of transformed or transgenic nature. In some embodiments, the host cell is a human cell. In some embodiments, the host cell is human T cell. In some embodiments, the host cell is derived from a human patient.

Useful host cells include but are not limited to microorganisms such as, bacteria (e.g., *E. coli, B. subtilis*) transformed with recombinant bacteriophage DNA, plasmid DNA or cosmid DNA expression vectors containing DDpp coding sequences; yeast (e.g., *Saccharomyces, Pichia*) transformed with recombinant yeast expression vectors containing DDpp coding sequences; insect cell systems infected with recombinant virus expression vectors (e.g., baculovirus) containing DDpp coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing DDpp coding sequences. In particular embodiments, the mammalian cell systems are used to produce the DDpp. Mammalian cell systems typically utilize recombinant expression constructs containing promoters derived from the genome of mammalian cells (e.g., metallothionein promoter) or from mammalian viruses (e.g., the adenovirus late promoter; the vaccinia virus 7.5K promoter).

Prokaryotes useful as host cells in producing a DDpp such as DDpp fusion protein, include gram negative or gram positive organisms such as, *E. coli* and *B. subtilis*. Expression vectors for use in prokaryotic host cells generally contain one or more phenotypic selectable marker genes (e.g., genes encoding proteins that confer antibiotic resistance or that supply an autotrophic requirement). Examples of useful prokaryotic host expression vectors include the pKK223-3 (Pharmacia, Uppsala, Sweden), pGEM1 (Promega, Wis., USA), pET (Novagen, Wis., USA) and pRSET (Invitrogen, Calif., USA) series of vectors (see, e.g., Studier, J. Mol. Biol. 219: 37 (1991) and Schoepfer, Gene 124: 83 (1993)). Exemplary promoter sequences frequently used in prokaryotic host cell expression vectors include T7, (Rosenberg et al., Gene 56: 125-135 (1987)), beta-lactamase (penicillinase), lactose promoter system (Chang et al., Nature 275: 615 (1978)); and Goeddel et al., Nature 281: 544 (1979)), tryptophan (trp) promoter system (Goeddel et al., Nucl. Acids Res. 8: 4057 (1980)), and tac promoter (Sambrook et al., 1990, Molecular Cloning, A Laboratory Manual, 2d Ed., Cold Spring Harbor Laboratory, Cold Spring Harbor, N.Y.).

In one embodiment, a eukaryotic host cell systems is be used, including yeast cells transformed with recombinant yeast expression vectors containing the coding sequence of a DDpp, such as, the expression systems taught in U.S. Appl. No. 60/344,169 and WO03/056914 (methods for producing humanlike glycoprotein in a non-human eukaryotic host cell) (the contents of each of which is herein incorporated by reference in its entirety). Exemplary yeast that can be used to produce the provided compositions, such as, DD, include yeast from the genus *Saccharomyces, Pichia, Actinomycetes* and *Kluyveromyces*. Yeast vectors typically contain an origin of replication sequence from a 2mu yeast plasmid, an autonomously replicating sequence (ARS), a promoter region, sequences for polyadenylation, sequences for transcription termination, and a selectable marker gene. Examples of promoter sequences in yeast expression constructs include, promoters from metallothionein, 3-phosphoglycerate kinase (Hitzeman, J. Biol. Chem. 255: 2073 (1980)) and other glycolytic enzymes, such as, enolase, glyceraldehyde-3-phosphate dehydrogenase, hexokinase, pyruvate decarboxylase, phosphofructokinase, glucose-6-phosphate isomerase, 3-phospho glycerate mutase, pyruvate kinase, triosephosphate isomerase, phosphoglucose isomerase, and glucokinase. Additional suitable vectors and promoters for use in yeast expression as well as yeast transformation protocols are known in the art. See, e.g., Fleer, Gene 107: 285-195 (1991) and Hinnen, PNAS 75: 1929 (1978).

Insect and plant host cell culture systems are also useful for producing the compositions encompassed by the disclosure. Such host cell systems include for example, insect cell systems infected with recombinant virus expression vectors (e.g., baculovirus) containing the coding sequence of a DD; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing the coding sequence of a DD, including, but not limited to, the expression systems taught in U.S. Pat. No. 6,815,184; U.S. Publ. Nos. 60/365,769, and 60/368,047; and WO04/057002, WO04/024927, and WO03/078614; the contents of each of which is herein incorporated by reference in its entirety.

In an additional embodiment the host cell systems may be used, including animal cell systems infected with recombinant virus expression vectors (e.g., adenoviruses, retroviruses, adeno-associated viruses, herpes viruses, lentiviruses) including cell lines engineered to contain multiple copies of the DNA encoding a DDpp either stably amplified (CHO/dhfr) or unstably amplified in double-minute chromosomes (e.g., murine cell lines). In one embodiment, the vector comprising the polynucleotide(s) encoding the DDpp is polycistronic. Exemplary mammalian cells useful for producing these compositions include 293 cells (e.g., 293T and 293F), CHO cells, BHK cells, NS0 cells, SP2/0 cells, YO myeloma cells, P3X63 mouse myeloma cells, PER cells, PER.C6 (Crucell, Netherlands) cells VERY, Hela cells, COS cells, MDCK cells, 3T3 cells, W138 cells, BT483 cells, Hs578T cells, HTB2 cells, BT20 cells, T47D cells, CRL7O30 cells, HsS78Bst cells, hybridoma cells, and other mammalian cells. Additional exemplary mammalian host cells that are useful in practicing the provided embodiments include but are not limited, to T cells. Some examples of expression systems and selection methods are described in the following references and references cited therein: Borth et al., Biotechnol. Bioen. 71(4): 266-73 (2000), in Werner et al., Arzneimittel-forschung/Drug Res. 48(8): 870-80 (1998), Andersen et al., Curr. Op. Biotechnol. 13: 117-123 (2002), Chadd et al., Curr. Op. Biotechnol. 12: 188-194 (2001), and Giddings, Curr. Op. Biotechnol. 12: 450-454 (2001). Additional examples of expression systems and selection methods are described in Logan et al., PNAS 81: 355-359 (1984), Birtner et al., Methods Enzymol. 153: 51-544 (1987)). Transcriptional and translational control sequences for mammalian host cell expression vectors are frequently derived from viral genomes. Commonly used promoter sequences and enhancer sequences in mammalian expression vectors include, sequences derived from Polyoma virus, Adenovirus 2, Simian Virus 40 (SV40), and human cytomegalovirus (CMV). Exemplary commercially available expression vectors for use in mammalian host cells include pCEP4 (Invitrogen) and pcDNA3 (Invitrogen).

Physical methods for introducing a nucleic acid into a host cell (e.g., a mammalian host cell) include calcium phosphate precipitation, lipofection, particle bombardment, microinjection, electroporation, and the like. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York).

Biological methods for introducing a polynucleotide of interest into a host cell include the use of DNA and RNA vectors. Viral vectors, and especially retroviral vectors, have become the most widely used method for inserting genes into mammalian (e.g., human) cells. Other viral vectors can be derived from lentivirus, poxviruses, herpes simplex virus I, adenoviruses and adeno-associated viruses, and the like. See, for example, U.S. Pat. Nos. 5,350,674 and 5,585,362, the contents of each of which is herein incorporated by reference in its entirety.

Methods for introducing a DNA and RNA polynucleotides of interest into a host cell include electroporation of cells, in which an electrical field is applied to cells in order to increase the permeability of the cell membrane, allowing chemicals, drugs, or polynucleotides to be introduced into the cell. DDpp containing DNA or RNA constructs may be introduced into mammalian or prokaryotic cells using electroporation.

In a preferred embodiment, electroporation of cells results in the expression of a DDpp-CAR on the surface of T cells, NK cells, NKT cells. Such expression may be transient or stable over the life of the cell. Electroporation may be accomplished with methods known in the art including MaxCyte GT® and STX® Transfection Systems (MaxCyte, Gaithersburg, Md., USA).

Chemical means for introducing a polynucleotide into a host cell include colloidal dispersion systems, such as macromolecule complexes, nanocapsules, microspheres, beads, and lipid-based systems including olLin-water emulsions, micelles, mixed micelles, and liposomes. An exemplary colloidal system for use as a delivery vehicle in vitro and in vivo is a liposome (e.g., an artificial membrane vesicle). In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid can be associated with a lipid. The nucleic acid associated with a lipid can be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they can be present in a bilayer structure, as micelles, or with a "collapsed" structure. They can also simply be interspersed in a solution, possibly forming aggregates that are not uniform in size or shape. Lipids are fatty substances which can be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristoyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristoyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform may be used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., Glycobiology 5: 505-510 (1991)). However, compositions that have different structures in solution than the normal vesicular structure are also encompassed. For example, the lipids can assume a micellar structure or merely exist as non-uniform aggregates of lipid molecules. Also contemplated are lipofectamine-nucleic acid complexes.

Regardless of the method used to introduce exogenous nucleic acids into a host cell, or the presence of the recombinant nucleic acid sequence in the host cell can routinely be confirmed through a variety of assays known in the art. Such assays include, for example, "molecular biological" assays known in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the provided embodiments.

Reporter genes are used for identifying potentially transfected cells and for evaluating the functionality of regulatory sequences. In general, a reporter gene is a gene that is not present in or expressed by the recipient organism, tissue, or cell and that encodes a polypeptide whose expression is manifested by some easily detectable property, e.g., enzymatic activity. Expression of the reporter gene is assayed at a suitable time after the DNA has been introduced into the recipient cells. A non-limiting list of suitable reporter genes can include genes encoding luciferase, beta-galactosidase, chloramphenicol acetyl transferase, secreted alkaline phosphatase, or the green fluorescent protein gene (e.g., Ui-Tei et al., FEBS Lett. 479: 79-82 (2000)). Suitable expression systems are known in the art and can be prepared using known techniques or obtained commercially. In general, the construct with the minimal 5' flanking region showing the highest level of expression of reporter gene is identified as the promoter. Such promoter regions can routinely be linked to a reporter gene and used to evaluate agents for the ability to modulate promoter-driven transcription.

A number of selection systems can be used in mammalian host-vector expression systems, including, but not limited to, the herpes simplex virus thymidine kinase, hypoxanthine-guanine phosphoribosyltransferase and adenine phosphoribosyltransferase (Lowy et al., Cell 22: 817 (1980)) genes, which can be employed in tk−, hgprt− or aprt− cells, respectively. Additionally, antimetabolite resistance can be used as the basis of selection for e.g., dhfr, gpt, neo, hygro, trpB, hisD, ODC (ornithine decarboxylase), and the glutamine synthase system.

Expression of Cell Associated DDpp

In another embodiment, the production of DDpp results in cell associated DDpp compositions. For example, the expression of recombinant vectors that encode DDpp operably linked to a cell membrane anchor or transmembrane domain have the potential to remain cell associated. DDpp comprising chimeric antigen receptors are intentionally cell associated and used in the context of the cell in which they are expressed. One particular embodiment relates to a strategy of adoptive cell transfer of T cells which have been transduced to express a DDpp chimeric antigen receptor (CAR). Preferably, the cell can be genetically modified to stably express a DDpp on its surface, conferring novel target specificity that is MHC independent.

A variety of viral-derived vectors can be used in applications in which viruses are used for transfection and integration into a mammalian cell genome. Viruses, which are useful as vectors include, but are not limited to, retroviruses, adenoviruses, adeno-associated viruses, herpes viruses, and lentiviruses. Lentiviral vectors are particularly suitable to achieving long-term gene transfer (e.g., adoptive T cell immune therapy) since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. In general, a suitable vector contains an origin of replication functional in at least one organism, a promoter sequence, convenient restriction endonuclease sites, and one or more selectable markers, (e.g., WO01/96584 and WO01/29058; and U.S. Pat. No. 6,326, 193). Several vector promoter sequences are available for expression of the transgenes. One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is EF1a. However, other constitutive promoter sequences can also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. Inducible promoters include, but are not limited to a metallothionein promoter, a glucocorticoid promoter, a progesterone promoter, and a tetracycline promoter.

In order to assess the expression of a DDpp-CAR polypeptide or portions thereof, the expression vector to be introduced into a cell can also contain either a selectable marker gene or a reporter gene or both to facilitate identification and selection of expressing cells from the population of cells sought to be transfected or infected through viral vectors, in other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Prior to expansion and genetic modification of the T cells, a source of T cells is obtained from a subject. T cells can be obtained from a number of sources, including peripheral blood mononuclear cells, bone marrow, lymph node tissue, cord blood, thymus tissue, tissue from a site of infection, ascites, pleural effusion, spleen tissue, and tumors. In various embodiments, any number of T cell lines available in the art, may be used.

A full discussion of T cell isolation, culturing, activation and expansion methods may be found in WO/12079000, the contents of which is herein incorporated by reference in its entirety.

Additionally provided is a host cell comprising nucleic acids encoding a DDpp described herein. Compositions comprising a nucleic acid sequence encoding the DDpp are also provided.

"Co-express" as used herein refers to simultaneous expression of two or more protein coding sequences. The coding sequences may be nucleic acids encoding, for example, a single protein or a chimeric protein as a single polypeptide chain.

Chemical Synthesis of DDpp

In addition to recombinant methods, DDpp production may also be carried out using organic chemical synthesis of the desired polypeptide using a variety of liquid and solid phase chemical processes known in the art. Various automatic synthesizers are commercially available and can be used in accordance with known protocols. See, for example, Tam et al., J. Am. Chem. Soc. 105: 6442 (1983); Merrifield, Science 232: 341-347 (1986); Barany and Merrifield, The Peptides, Gross and Meienhofer, eds, Academic Press, New York, 1-284; Barany et al., Int. J. Pep. Protein Res. 30: 705-739 (1987); Kelley et al. in Genetic Engineering Principles and Methods, Setlow, J. K., ed. Plenum Press, NY. 1990, vol. 12, pp. 1-19; Stewart et al., Solid-Phase Peptide Synthesis, W. H. Freeman Co., San Francisco, 1989. One advantage of these methodologies is that they allow for the incorporation of non-natural amino acid residues into the sequence of the DDpp.

The DDpp that are used in the methods encompassed herein may be modified during or after synthesis or translation, e.g., by glycosylation, acetylation, benzylation, phosphorylation, amidation, pegylation, formylation, derivatization by known protecting/blocking groups, proteolytic cleavage, linkage to an antibody molecule, hydroxylation, iodination, methylation, myristoylation, oxidation, pegylation, proteolytic processing, phosphorylation, prenylation, racemization, selenoylation, sulfation, ubiquitination, etc. (See, e.g., Creighton, Proteins: Structures and Molecular Properties, 2d Ed. (W. H. Freeman and Co., N.Y., 1992); Postranslational Covalent Modification of Proteins, Johnson, ed. (Academic Press, New York, 1983), pp. 1-12; Seifter, Meth. Enzymol. 182: 626-646 (1990); Rattan, Ann. NY Acad. Sci. 663: 48-62 (1992).) In specific embodiments, the peptides are acetylated at the N-terminus and/or amidated at the C-terminus.

The disclosure also provides DDpp derivatives and include polypeptides that have been chemically modified in some manner distinct from addition, deletion, or substitution of amino acids. In this regard, a DDpp is chemically bonded with polymers, lipids, other organic moieties, and/or inorganic moieties. Exemplary polypeptide modifications are provided in Hermanson, Bioconjugate Techniques, Academic Press, (1996). The DDpp optionally comprise a functional group that facilitates conjugation to another moiety (e.g., a peptide moiety). Exemplary functional groups include, but are not limited to, isothiocyanate, isocyanate, acyl azide, NHS ester, sulfonyl chloride, aldehyde, epoxide, oxirane, carbonate, arylating agent, imidoester, carbodiimide, anhydride, alkyl halide derivatives (e.g., haloacetyl derivatives), maleimide, aziridine, acryloyl derivatives, arylating agents, thiol-disulfide exchange reagents (e.g., pyridyl disulfides or TNB thiol), diazoalkane, carboyldiimadazole, N,N'-Disuccinyl carbonate, N-Hydroxysuccinimidyl chloroformate, and hydrazine derivatives. Maleimide is useful, for example, for generating a DDpp that binds albumin in vivo.

In some embodiments, the DDpp is covalently modified to include one or more water soluble polymer attachments. The water soluble polymer (or other chemical moiety) is attached to any amino acid residue, although attachment to the N- or C-terminus is preferred in some embodiments. Useful polymers include, but are not limited to, PEG (e.g., PEG approximately 40 kD, 30 kD, 20 kD, 10 kD, 5 kD, or 1 kD in size), polyoxyethylene glycol, polypropylene glycol, monomethoxy-polyethylene glycol, dextran, hydroxyethyl starch, cellulose, poly-(N-vinyl pyrrolidone)-polyethylene glycol, propylene glycol homopolymers, a polypropylene oxide/ethylene oxide co-polymer, polysialic acid (PSA), polyoxyethylated polyols (e.g., glycerol) and polyvinyl alcohol, as well as mixtures of any of the foregoing. In one embodiment, the DDpp is PEGylated. PEG moieties are available in different shapes, e.g., linear or branched. For further discussion of water soluble polymer attachments, see U.S. Pat. Nos. 4,640,835; 4,496,689; 4,301,144; 4,670,417; 4,791,192; and 4,179,337. Other moieties useful for improving peptide half-life or stability are described herein and include, for instance, albumin (optionally modified to allow conjugation to the DDpp), fatty acid chains (e.g., C12-C18 fatty acid, such as a C14 fatty acid, or dicarboxylic acids, such as octadecane dicarboxylic acid (oddc)), an antibody or fragment thereof (e.g., an Fc portion of an antibody), and proline-alanine-serine multimers.

In some embodiments, the DDpp is conjugated to a polyethylene glycol (PEG) moiety, human serum albumin (HSA), an antibody or antibody fragment, hydroxyethyl starch, a proline-alanine-serine multimer (PASylation), a C12-C18 fatty acid, or polysialic acid.

In some embodiments, the DDpp are acylated at the N-terminal amino acid of the peptide. In another aspect, the DDpp are amidated at the C-terminal amino acid of the polypeptide. In a still further aspect, the peptides are acylated at the N-terminal amino acid of the peptide and are amidated at the C-terminal amino acid of the peptide.

In some embodiments, the DDpp comprises one or more modified or non-proteinogenic amino acids or a modified linker group (see, e.g., Grant, Synthetic Peptides: A User's Guide, Oxford University Press (1992)). Modified amino acids include, for example, amino acids wherein the amino and/or carboxyl group is replaced by another group. Non-limiting examples include modified amino acids incorporating thioamides, ureas, thioureas, acylhydrazides, esters, olefines, sulfonamides, phosphoric acid amides, ketones, alcohols, boronic acid amides, benzodiazepines and other aromatic or non-aromatic heterocycles (see, Estiarte et al., Burgers Medicinal Chemistry, 6.sup.th edition, Volume 1, Part 4, John Wiley & Sons, New York (2002)). Non-proteinogenic amino acids include, but are not limited to, beta-alanine (Bal), norvaline (Nva), norleucine (Nle), 4-aminobutyric acid (gamma-Abu), 2-aminoisobutyric acid (Aib), 6-aminohexanoic acid (epsilon-Ahx), ornithine (Orn), hydroxyproline (Hyp), taurine, sarcosine, citrulline (Cit), cysteic acid (Coh), cyclohexylalanine (Cha), methionine-sulfoxide (Meo), methioninesulfone (Moo), homoserine-methylester (Hsm), propargylglycine (Eag), 5-fluorotryptophan (5Fw), 6-fluorotryptophan (6Fw), 3',4'-dimethoxyphenyl-alanine (Ear), 3',4'-difluorophenylalanine (Dff), 4'-fluorophenyl-alanine (Pff), 1-naphthyl-alanine (1Ni), 2-Naphthylalanine (2Ni), 1-methyltryptophan (1Mw), penicillamine (Pen), homoserine (Hse), t-butylglycine, t-butylalanine, phenylglycine (Phg), benzothienylalanine (Bta), L-homo-cysteine (Hcy), N-methyl-phenylalanine (Nmf), 2-thienylalanine (Thi), 3,3-diphenylalanine (Ebw), L-alpha-t-Butylglycine (Tle), Bpa, homophenylalanine (Hfe), and S-benzyl-L-cysteine (Ece). These and other non-proteinogenic amino acids may exist as D- or L-isomers. Examples of modified linkers include but are not limited to the flexible linker 4,7,10-trioxa-1,13-tridecanediamine (Ttds), glycine, 6-aminohexanoic acid, beta-alanine (Bal), pentynoic acid (Pyn), and combinations of Ttds, glycine, 6-aminohexanoic acid and Bal.

Any of numerous chemical modifications may be carried out by known techniques, including, but not limited to acetylation, formylation, etc. Additionally, the derivative may contain one or more non-classical amino acids.

TABLE 1

Exemplary target-specific binding DDs

| SEQ NO: | D-Domain Sequence | Target | ELISA_avg |
|---|---|---|---|
| 11 | MGSWYEFSWRLQAIHQRLNALGGSEAELAAFEKEIAAFESELQAYKGKGNPEVEELRAYAAGIRGALQAYRHN | BCMA | 9.48683 |
| 12 | MGSWHEFTWRLIAIQQRLEALGGSEAELAAFEKEIAAFESELQAYKGKGNPEVEELRAYAAGIRHHLQAYRHN | BCMA | 17.125 |
| 13 | MGSWREFAWRLVAINSRLKALGGSEAELAAFEKEIAAFESELQAYKGKGNPEVEELRHYAASIRDGLQAYRHN | BCMA | 9.66 |
| 14 | MGSWHEFAWRLQAINQRLNALGGSEAELAAFEKEIAAFESELQAYKGKGNPEVEELRHYAAHIRNGLQAYRHN | BCMA | 13.14 |
| 15 | MGSWNEFAWRLTAIEQRLMALGGSEAELAAFEKEIAAFESELQAYKGKGNPEVEELRHYAAGIRDNLQAYRHN | BCMA | 18.28 |
| 16 | MGSWTEFAWRLQAIHQRLQALGGSEAELAAFEKEIAAFESELQAYKGKGNPEVEELRVYAAKIRISLQAYRHN | BCMA | 18.71 |
| 17 | MGSWIEFAWRLQAIHQRLDALGGSEAELAAFEKEIAAFESELQAYKGKGNPEVEDLREYAANIRDSLQAYRHN | BCMA | 18.97 |
| 18 | MGSWHEFTWRLVAIQQRLQALGGSEAELAAFEKEIAAFESELQAYKGKGNPEVEELRKFAAKIRYELQAYRHN | BCMA | 19.51 |
| 19 | MGSWHEFTWRLIAIRERLFALGGSEAELAAFEKEIAAFESELQAYKGKGNPEVEELREYAASIRNMLQAYRHN | BCMA | 12.99 |
| 20 | MGSWIEFSWRLEAIRQRLQALGGSEAELAAFEKEIAAFESELQAYKGKGNPEVESLRSYAARIRQELQAYRHN | BCMA | 9.92 |
| 21 | MGSWVEFSWRLEAIRQRLQALGGSEAELAAFEKEIAAFESELQAYKGKGNPEVESLRSYAARIRQELQAYRHN | BCMA | 19.14 |
| 22 | MGSWVEFSWRLEAIRQRLTALGGSEAELAAFEKEIAAFESELQAYKGKGNPEVEDLRKYAARIRGELQAYRHN | BCMA | 21.3 |
| 23 | MGSWVEFAWRLTAIDQRLSALGGSEAELAAFEKEIAAFESELQAYKGKGNPEVENLRFYAAKIRSHLQAYRHN | BCMA | 8.43 |
| 24 | MGSWVEFAWRLEAIKQRLTALGGSEAELAAFEKEIAAFESELQAYKGKGNPEVEELRLYAAKIRRVLQAYRHN | BCMA | 8.9 |
| 25 | MGSWVEFAWRLTAIHTRLWALGGSEAELAAFEKEIAAFESELQAYKGKGNPEVESLRKYAAKIRKQLQAYRHN | BCMA | 6.08 |
| 26 | MGSWTEFAWRLEAINQRLQALGGSEAELAAFEKEIAAFESELQAYKGKGKPEVEALRAYAAKIRTRLQAYRHN | BCMA | 15.1475 |
| 27 | MGSWSEFAWRLEAIHQRLSALGGSEAELAAFEKEIAAFESELQAYKGKGNPEVESLRLFAAQIRENLQAYRHN | BCMA | 18.04 |
| 28 | MGSWNEFAWRLIAINQRLWALGGSEAELAAFEKEIAAFESELQAYKGKGNPEVESLRHFAANIRNDLQAYRHN | BCMA | 11.53 |
| 29 | MGSWTEFAWRLIAIDQRLMALGGSEAELAAFEKEIAAFESELQAYKGKGNPEVEILRELAAEIRFHLQAYRHN | BCMA | 8.55 |
| 30 | MGSWSEFMNRLDAITYRLVALGGSEAELAAFEKEIAAFESELQAYKGKGNPEVELLRHYAAQIRDSLQAYRHN | BCMA | 12.9 |
| 31 | MGSWTEFMERLDAISYRLWALGGSEAELAAFEKEIAAFESELQAYKGKGNPEVEVLRDYAAIIRNSLQAYRHN | BCMA | 9.87 |
| 32 | MGSWAEFMDRLDAITYRLWALGGSEAELAAFEKEIAAFESELQAYKGKGNPEVEELRGYAAIIRSELQAYRHN | BCMA | 10.83 |
| 33 | MGSWIEFQERLDAIFYRLHALGGSEAELAAFEKEIAAFESELQAYKGKGNPEVEDLRDAAATIRRQLQAYRHN | BCMA | 18.58 |
| 34 | MGSWIEFQQRLDAIFYRLYALGGSEAELAAFEKEIAAFESELQAYKGKGNPEVENLRDMAAIIRKQLQAYRHN | BCMA | 20.02 |
| 35 | MGSWYEFQSRLDAIFYRLFALGGSEAELAAFEKEIAAFESELQAYKGKGNPEVEKLREAAASIRTQLQAYRHN | BCMA | 14.08 |

TABLE 1-continued

Exemplary target-specific binding DDs

| SEQ NO: | D-Domain Sequence | Target | ELISA_avg |
|---|---|---|---|
| 36 | MGSWSEFIDRLDAITYRLFALGGSEAELAAFEKEIAAFESE LQAYKGKGNPEVENLRWYAGVIREQLQAYRHN | BCMA | 10.18 |
| 37 | MGSWSEFYDRLYAINQRLFALGGSEAELAAFEKEIAAFESE LQAYKGKGNPEVEDLRWYAAFIRAQLQAYRHN | BCMA | 5.98 |
| 38 | MGSWYEFYDRLDAIVHRLDALGGSEAELAAFEKEIAAFESE LQAYKGKGNPEVENLRWYAAMIRVRLQAYRHN | BCMA | 14.68 |
| 39 | MGSWVEFQDRLEAITDRLYALGGSEAELAAFEKEIAAFESE LQAYKGKGNPEVEELRYSAAMIRVILQAYRHN | BCMA | 8.87825 |
| 40 | MGSWVEFQERLMAISDRLYALGGSEAELAAFEKEIAAFESE LQAYKGKGNPEVEELRWQAAMIRYTLQAYRHN | BCMA | 6.7 |
| 41 | MGSWFEFQHRLEAISMRLHALGGSEAELAAFEKEIAAFESE LQAYKGKGNPEVEELRWQAAYIRVVLQAYRHN | BCMA | 4.05 |
| 42 | MGSWVEFQSRLEAIATRLRALGGSEAELAAFEKEIAAFESE LQAYKGKGNPEVEELRWQAAWIRMMLQAYRHN | BCMA | 18.0075 |
| 43 | MGSWEEFQYRLGAIAARLQALGGSEAELAAFEKEIAAFESE LQAYKGKGNPEVEELRWQAAMIRFMLQAYRHN | BCMA | 3.11 |
| 44 | MGSWYEFQVRLQAISWRLKALGGSEAELAAFEKEIAAFESE LQAYKGKGNHEVEELRIQAALIRVMLQAYRHN | BCMA | 14.23 |
| 45 | MGSWVEFRSRLEAISNRLRALGGSEAELAAFEKEIAAFESE LQAYKGKGNPEVEELRTTAALIRVYLQAYRHN | BCMA | 3.04 |
| 46 | MGSWVEFKARLEAISSRLTALGGSEAELAAFEKEIAAFESE LQAYKGKGNPEVEELRYSAALIRVYLQAYRHN | BCMA | 8.70714 |
| 47 | MGSWSEFYTRLEAINNRLHALGGSEAELAAFEKEIAAFESE LQAYKGKGNPEVEELRYTAALIRIYLQAYRHN | BCMA | 3.66 |
| 48 | MGSWAEFYHRLDAISSRLRALGGSEAELAAFEKEIAAFESE LQAYKGKGNPEVEELRYTAALIRIYLQAYRHN | BCMA | 4.31 |
| 49 | MGSWTEFASRLVAIRQRLQALGGSEAELAAFEKEIAAFESE LQAYKGKGNPEVEELRYSAAIIRVMLQAYRHN | BCMA | 7.99 |
| 50 | MGSWSEFDQRLAAIYQRLNALGGSEAELAAFEKEIAAFESE LQAYKGKGNPEVEELRYSAALIRVMLQAYRHN | BCMA | 7.72 |
| 51 | MGSWVEFHNRLSAISDRLGALGGSEAELAAFEKEIAAFESE LQAYKGKGNPEVEELRYSAALIRVMLQAYRHN | BCMA | 7.36 |
| 52 | MGSWNEFEDRLSAISARLSALGGSEAELAAFEKEIAAFESE LQAYKGKGNPEVEELRYSAALIRVMLQAYRHN | BCMA | 4.09 |
| 53 | MGSWVEFEYRLVAIFDRLQALGGSEAELAAFEKEIAAFESE LQAYKGKGNPEVEELRYQAALIRVMLQAYRHN | BCMA | 7.63 |
| 54 | MGSWVEFQGRLGAIHERLQALGGSEAELAAFEKEIAAFESE LQAYKGKGNPEVEELRYSAALIRVFLQAYRHN | BCMA | 3.83429 |
| 55 | MGSWYEFSMRLSAIWERLHALGGSEAELAAFEKEIAAFESE LQAYKGKGNPEVEELRYQAALIRFYLQAYRHN | BCMA | 7.12 |
| 56 | MGSWTEFSQRLGAISERLYALGGSEAELAAFEKEIAAFESE LQAYKGKGNPEVEELRYSAALIRFMLQAYRHN | BCMA | 4.15 |
| 57 | MGSWTEFHDRLEAITHRLNALGGSEAELAAFEKEIAAFESE LQAYKGKGNPEVEELRYSAALLRVFLQAYRHN | BCMA | 5.79 |
| 58 | MGSWTEFEHRLEAIAGRLNALGGSEAELAAFEKEIAAFESE LQAYKGKGNPEVEELRYSAALIRFWLQAYRHN | BCMA | 6.34 |
| 59 | MGSWTEFANRLEAINARLHALGGSEAELAAFEKEIAAFESE LQAYKGKGNPEVEELRFSAALIRVYLQAYRHN | BCMA | 6.42 |
| 60 | MGSWEEFDRRLYAIARRLEALGGSEAELAAFEKEIAAFESE LQAYKGKGNPEVEELRYQAALIRVWLQAYRHN | BCMA | 8.85 |

TABLE 1-continued

Exemplary target-specific binding DDs

| SEQ NO: | D-Domain Sequence | Target | ELISA_avg |
|---|---|---|---|
| 61 | MGSWIEFHQRLEAIVTRLEALGGSEAELAAFEKEIAAFESELQAYKGKGNPEVEELRYQAALIRVFLQAYRHN | BCMA | 8 |
| 62 | MGSWSEFYDRLKAIADRLHALGGSEAELAAFEKEIAAFESELQAYKGKGNPEVEELRTEAAIIRVYLQAYRHN | BCMA | 8.215 |
| 63 | MGSWWEFEDRLSAIMERLHALGGSEAELAAFEKEIAAFESELQAYKGKGNPEVEELRYAAIIRVYLQAYRHN | BCMA | 10.39 |
| 64 | MGSWVEFEERLAAIATRLHALGGSEAELAAFEKEIAAFESELQAYKGKGNPEVEELRWRAAIIRVYLQAYRHN | BCMA | 16.29 |
| 65 | MGSWSEFRGRLQAIHSRLNALGGSEAELAAFEKEIAAFESELQAYKGKGNPEVEELRYSAAIIRIYLQAYRHN | BCMA | 7.585 |
| 66 | MGSWTEFRDRLGAIYHRLDALGGSEAELAAFEKEIAAFESELQAYKGKGNPEVEELRYQAAIIRVYLQAYRHN | BCMA | 6.7 |
| 67 | MGSWVEFYHRLEAIRYRLSALGGSEAELAAFEKEIAAFESELQAYKGKGNPEVEELRYVAAVIRYRLQAYRHN | BCMA | 7.8 |
| 68 | MGSWVEFYDRLEAIRYRLSALGGSEAELAAFEKEIAAFESELQAYKGKGNPEVEELRYIAAVIRYRLQAYRHN | BCMA | 5.636 |
| 69 | MGSWVEFYDRLAAIRKRLYALGGSEAELAAFEKEIAAFESELQAYKGKGNPEVEELRFRAALIRIWLQAYRHN | BCMA | 9.76 |
| 70 | MGSWEEFSERLEAISIRLRALGGSEAELAAFEKEIAAFESELQAYKGKGNPEVEELRVSAAIIRVWLQAYRHN | BCMA | 11.26 |
| 71 | MGSWSEFSDRLHAISDRLQALGGSEAELAAFEKEIAAFESELQAYKGKGNPEVEELRIQAAIIRVWLQAYRHN | BCMA | 6.3725 |
| 72 | MGSWIEFSHRLEAIVDRLGALGGSEAELAAFEKEIAAFESELQAYKGKGNPEVEELRNTAAIIRVYLQAYRHN | BCMA | 18.67 |
| 73 | MGSWEEFSDRLEAILRRLDALGGSEAELAAFEKEIAAFESELQAYKGKGNPEVEDLRFAAAIIRVQLQAYRHN | BCMA | 9.08 |
| 74 | MGSWMEFSHRLDAIHERLYALGGSEAELAAFEKEIAAFESELQAYKGKGNPEVEDLRFAAAIIRVQLQAYRHN | BCMA | 6.3 |
| 75 | MGSWSEFQQRLHAIRTRLYALGGSEAELAAFEKEIAAFESELQAYKGKGNPEVEELRFEAAIIRVMLQAYRHN | BCMA | 11.615 |
| 76 | MGSWYEFQNRLGAINRRLNALGGSEAELAAFEKEIAAFESELQAYKGKGNPEVEELRFEAAIIRVMLQAYRHN | BCMA | 4.68 |
| 77 | MGSWQEFTGRLHAIRHRLEALGGSEAELAAFEKEIAAFESELQAYKGKGNPEVEELRFEAAYIRVWLQAYRHN | BCMA | 3.315 |
| 78 | MGSWTEFDHRLGAIWERLVALGGSEAELAAFEKEIAAFESELQAYKGKGNPEVEELRFHAAIIRIFLQAYRHN | BCMA | 9.54 |
| 79 | MGSWTEFHVRLSAIWDRLVALGGSEAELAAFEKEIAAFESELQAYKGKGNPEVEELRFHAAIIRIVLQAYRHN | BCMA | 23.62 |
| 80 | MGSWNEFDNRLQAIWDRLHALGGSEAELAAFEKEIAAFESELQAYKGKGNPEVEELRFHAAMIRITLQAYRHN | BCMA | 9.87 |
| 81 | MGSWTEFHERLQAIWPRLHALGGSEAELAAFEKEIAAFESELQAYKGKGNPEVEELRFRAAIIRLYLQAYRHN | BCMA | 12.0656 |
| 82 | MGSWNEFSGRLTAIKDRLAALGGSEAELAAFEKEIAAFESELQAYKGKGNPEVEELRFRAAVIRLWLQAYRHN | BCMA | 3.39 |
| 83 | MGSWVEFDERLVAIWFRLHALGGSEAELAAFEKEIAAFESELQAYKGKGNPEVEALRARAAYIRIWLQAYRHN | BCMA | 8.96 |
| 84 | MGSWSEFGQRLSAIWERLLALGGSEAELAAFEKEIAAFESELQAYKGKGNPEVEALRADAAFIRIWLQAYRHN | BCMA | 14.01 |
| 85 | MGSWYEFEDRLVAIWIRLDALGGSEAELAAFEKEIAAFESELQAYKGKGNPEVEELRYNAAFIRGALQAYRHN | BCMA | 4.93 |

TABLE 1-continued

Exemplary target-specific binding DDs

| SEQ NO: | D-Domain Sequence | Target | ELISA_avg |
|---|---|---|---|
| 86 | MGSWYEFGDRLSAIWERLAALGGSEAELAAFEKEIAAFESE LQAYKGKGNPEVEYLRTHAAEIRTILQAYRHN | BCMA | 8.895 |
| 87 | MGSWHEFYYRLEAIEQRLHALGGSEAELAAFEKEIAAFESE LQAYKGKGNPEVETLRFDAALIRIYLQAYRHN | BCMA | 3.73 |
| 88 | MGSWSEFEERLAAIGSRLFALGGSEAELAAFEKEIAAFESE LQAYKGKGNPEVETLRFDAALIRIYLQAYRHN | BCMA | 4.85 |
| 89 | MGSWLEFHYRLHAIQFRLYALGGSEAELAAFEKEIAAFESE LQAYKGKGNPEVETLRHIAALIRNQLQAYRHN | BCMA | 12.7486 |
| 90 | MGSWQEFYNRLEAIHMRLFALGGSEAELAAFEKEIAAFESE LQAYKGKGNPEVEGLRSDAAPIRDVLQAYRHN | BCMA | 6.47 |
| 91 | MGSWNEFHHRLWAIFDRLGALGGSEAELAAFEKEIAAFESE LQAYKGKGNPEVEVLRKMAAGIRGGLQAYRHN | BCMA | 3.88 |
| 92 | MGSWYEFHYRLKAINDRLYALGGSEAELAAFEKEIAAFESE LQAYKGKGNPEVEYLRYSAAMIRHKLQAYRHN | BCMA | 6.04 |
| 93 | MGSWTEFHQRLGAIHARLGALGGSEAELAAFEKEIAAFESE LQAYKGKGNPEVEYLRFSAAFIRLKLQAYRHN | BCMA | 8.87 |
| 94 | MGSWFEFQYRLEAIFYRLLALGGSEAELAAFEKEIAAFESE LQAYKGKGKPEVEELRVRAALIRHLLQAYRHN | BCMA | 17.31 |
| 95 | MGSWVEFHARLDAIYTRLGALGGSEAELAAFEKEIAAFESE LQAYKGKGNPEVEYLRVLAAHIRISLQAYRHN | BCMA | 3.8 |
| 96 | MGSWVEFGTRLSAIYNRLWALGGSEAELAAFEKEIAAFESE LQAYKGKGNPEVEDLRFEAAIIRIMLQAYRHN | BCMA | 15.425 |
| 97 | MGSWVEFTHRLDAIYIRLWALGGSEAELAAFEKEIAAFESE LQAYKGKGNPEVEELRHEAAVIREELQAYRHN | BCMA | 13.9167 |
| 98 | MGSWVEFHGRLAAIYVRLFALGGSEAELAAFEKEIAAFESE LQAYKGKGNPEVESLRYHAAMIRRNLQAYRHN | BCMA | 4 |
| 99 | MGSWVEFDRRLVAIYIRLWALGGSEAELAAFEKEIAAFESE LQAYKGKGNPEVEALRDDAALIRLLLQAYRHN | BCMA | 8.93 |
| 100 | MGSWVEFDRRLVAIYIRLWALGGSEAELAAFEKEIAAFESE LQAYKGKGNPEVEKLRYDAATIRETLQAYRHN | BCMA | 8 |
| 101 | MGSWLEFDRRLTAIYLRLWALGGSEAELAAFEKEIAAFESE LQAYKGKGNPEVEALREDAAMIRDMLQAYRHN | BCMA | 9.82 |
| 102 | MGSWIEFDRRLLAIHVRLWALGGSEAELAAFEKEIAAFESE LQAYKGKGNPEVEVLRADAAKIRMELQAYRHN | BCMA | 13.72 |
| 103 | MGSWIEFDRRLIAIWIRLWALGGSEAELAAFEKEIAAFESE LQAYKGKGNPEVESLRSDAADIRQKLQAYRHN | BCMA | 9.45 |
| 104 | MGSWVEFDRRLIAIWVRLWALGGSEAELAAFEKEIAAFESE LQAYKGKGNPEVEFLRSDAAMIREHLQAYRHN | BCMA | 5.77 |
| 105 | MGSWYEFHTRLIAIYVRLWALGGSEAELAAFEKEIAAFESE LQAYKGKGNPEVEWLRGDAAKIRGYLQAYRHN | BCMA | 4.06 |
| 106 | MGSWSEFSTRLSAIYVRLWALGGSEAELAAFEKEIAAFESE LQAYKGKGNPEVEYLRNKAASIRKTLQAYRHN | BCMA | 5.35 |
| 107 | MGSWVEFRYRLGAIYHRLWALGGSEAELAAFEKEIAAFESE LQAYKGKGNPEVEVLRDRAATIRRLLQAYRHN | BCMA | 10.81 |
| 108 | MGSWNEFRNRLGAIDSRLWALGGSEAELAAFEKEIAAFESE LQAYKGKGNPEVETLRAHAAIIRSVLQAYRHN | BCMA | 4.69667 |
| 109 | MGSWHEFRNRLGAIDSRLWALGGSEAELAAFEKEIAAFESE LQAYKGKGNPEVETLRARAAMIRSVLQAYRHN | BCMA | 3.49359 |
| 110 | MGSWTEFYQRLEAINFRLWALGGSEAELAAFEKEIAAFESE LQAYKGKGNPEVEVLRDKAALIRLMLQAYRHN | BCMA | 6.955 |

TABLE 1-continued

Exemplary target-specific binding DDs

| SEQ NO: | D-Domain Sequence | Target | ELISA_avg |
|---|---|---|---|
| 111 | MGSWNEFYNRLHAINLRLWALGGSEAELAAFEKEIAAFESELQAYKGKGNPEVEVLREHAAIIRQALQAYRHN | BCMA | 3.00395 |
| 112 | MGSWEEFYGRLSAIQDRLWALGGSEAELAAFEKEIAAFESELQAYKGKGNPEVEWLRMHAAVIRRALQAYRHN | BCMA | 3.28 |
| 113 | MGSWGEFNLRLVAIHVRLWALGGSEAELAAFEKEIAAFESELQAYKGKGNPEVEFLRSQAANIRAQLQAYRHN | BCMA | 12.81 |
| 114 | MGSWGEFSDRLEAINERLWALGGSEAELAAFEKEIAAFESELQAYKGKGNPEVEELRWQAAFIRANLQAYRHN | BCMA | 4.26 |
| 115 | MGSWMEFQGRLPAILARLRALGGSEAELAAFEKEIAAFESELQAYKGKGNPEVEHLRDKAAYIRWMLQAYRHN | BCMA | 8.32 |
| 116 | MGSWMEFEGRLPAILARLRALGGSEAELAAFEKEIAAFESELQAYKGKGNPEVEHLRDKAAYIRWMLQAYRHN | BCMA | 3.93 |
| 117 | MGSWFEFQNRLQAILFRLRALGGSEAELAAFEKEIAAFESELQAYKGKGNPEVENLRDKAAYIRLMLQAYRHN | BCMA | 5.39333 |
| 118 | MGSWVEFDMRLQAILERLRALGGSEAELAAFEKEIAAFESELQAYKGKGNPEVEHLRDSAAYIRLMLQAYRHN | BCMA | 23.525 |
| 119 | MGSWVEFNARLDAILFRLRALGGSEAELAAFEKEIAAFESELQAYKGKGNPEVEHLRDQAAYIRLMLQAYRHN | BCMA | 13.52 |
| 120 | MGSWMEFNVRLRAILDRLHALGGSEAELAAFEKEIAAFESELQAYKGKGNPEVELLRDKAAYIRFMLQAYRHN | BCMA | 15.59 |
| 121 | MGSWIEFDTRLAAIVHRLRALGGSEAELAAFEKEIAAFESELQAYKGKGNPEVELLRDKAAYIRYMLQAYRHN | BCMA | 13.9475 |
| 122 | MGSWIEFDYRLKAILHRLRALGGSEAELAAFEKEIAAFESELQAYKGKGNPEVEGLRDKAAYIRFLLQAYRHN | BCMA | 11.8767 |
| 123 | MGSWYEFEDRLLAIKVRLRALGGSEAELAAFEKEIAAFESELQAYKGKGNPEVEYLRDQAAYIRFMLQAYRHN | BCMA | 17.6133 |
| 124 | MGSWYEFQDRLSAITTRLRALGGSEAELAAFEKEIAAFESELQAYKGKGNPEVELLRDKAAYIRFMLQAYRHN | BCMA | 10.085 |
| 125 | MGSWEEFDDRLNAIVYRLRALGGSEAELAAFEKEIAAFESELQAYKGKGNPEVEMLRDQAAYIRLMLQAYRHN | BCMA | 18.64 |
| 126 | MGSWVEFEQRLHAIVVRLRALGGSEAELAAFEKEIAAFESELQAYKGGGNPEVENLRDQAAYIRFMLQAYRHN | BCMA | 17.7467 |
| 127 | MGSWVEFEWRLEAIVVRLRALGGSEAELAAFEKEIAAFESELQAYKGKGNPEVEHLRDKAAYIRYMLQAYRHN | BCMA | 14.95 |
| 128 | MGSWYEFEHRLKAIVSRLGALGGSEAELAAFEKEIAAFESELQAYKGKGNPEVEHLRDKAAYIRYMLQAYRHN | BCMA | 4.55 |
| 129 | MGSWMEFKHRLAAITFRLRALGGSEAELAAFEKEIAAFESELQAYKGKGNPEVELLRDKAAYIRLLLQAYRHN | BCMA | 6.06 |
| 130 | MGSWMEFEGRLHAIKRRLRALGGSEAELAAFEKEIAAFESELQAYKGKGNPEVEVLRDQAAYIRLLLQAYRHN | BCMA | 7.335 |
| 131 | MGSWSEFVFRLDTIKSRLRALGGSEAELAAFEKEIAAFESELQAYKGKGNPEVETLRDQAAYIRLMLQAYRHN | BCMA | 19.86 |
| 132 | MGSWYEFDERLSAIKLRLRALGGSEAELAAFEKEIAAFESELQAYKGKGNPEVEVLRAQAAYIRAILQAYRHN | BCMA | 16.94 |
| 133 | MGSWMEFDERLWAIKKRLRALGGSEAELAAFEKEIAAFESELQAYKGKGNPEVEFLRHQAAYIRMLLQAYRHN | BCMA | 9.526 |
| 134 | MGSWHEFDGRLSAIKRRLWALGGSEAELAAFEKEIAAFESELQAYKGKGNPEVEHLRDQAAYIRYMLQAYRHN | BCMA | 5.4 |
| 135 | MGSWYEFDGRLQAIIARLRALGGSEAELAAFEKEIAAFESELQAYKGKGNPEVEHLRFRAAYIRWILQAYRHN | BCMA | 3.29 |

TABLE 1-continued

Exemplary target-specific binding DDs

| SEQ NO: | D-Domain Sequence | Target | ELISA_avg |
|---|---|---|---|
| 136 | MGSWFEFDKRLYAIIHRLRALGGSEAELAAFEKEIAAFESE LQAYKGKGNPEVEKLRYKAAIIRLYLQAYRHN | BCMA | 11.82 |
| 137 | MGSWVEFDNRLYAIVDRLRALGGSEAELAAFEKEIAAFESE LQAYKGKGNPEVEHLRQKAAYIRLILQAYRHN | BCMA | 11.7167 |
| 138 | MGSWIEFHQRLNAIFNRLRALGGSEAELAAFEKEIAAFESE LQAYKGKGNPEVEWLRHHAAYIREMLQAYRHN | BCMA | 7.34167 |
| 139 | MGSWNEFRLRLWAITERLRALGGSEAELAAFEKEIAAFESE LQAYKGKGNPEVECLRAEAAWIRTMLQAYRHN | BCMA | 3.87179 |
| 140 | MGSWYEFWLRLSAISYRLQALGGSEAELAAFEKEIAAFESE LQAYKGKGNPEVEWLRKEAAEIRSWLQAYRHN | BCMA | 14.4653 |
| 141 | MGSWYEFQLRLWAIHWRLIALGGSEAELAAFEKEIAAFESE LQAYKGKGNPEVEWLRMRAAEIRNELQAYRHN | BCMA | 20.59 |
| 142 | MGSWYEFAHRLEAIEWRLIALGGSEAELAAFEKEIAAFESE LQAYKGKGNPEVEELRQYAAAIRNYLQAYRHN | BCMA | 9.48 |
| 143 | MGSWYEFDTRLGAIRNRLGALGGSEAELAAFEKEIAAFESE LQAYKGKGNPEVEWLRFQAAYIRFLLQAYRHN | BCMA | 13.934 |
| 144 | MGSWYEFWVRLTAIRWRLEALGGSEAELAAFEKEIAAFESE LQAYKGKGNPEVEWLREQAASIRWVLQAYRHN | BCMA | 5.72 |
| 145 | MGSWFEFDRRLKAIDRRLMALGGSEAELAAFEKEIAAFESE LQAYKGKGNPEVEWLRMQAAIIRNYLQAYRHN | BCMA | 6.1625 |
| 146 | MGSWVEFWERLDAIDNRLGALGGSEAELAAFEKEIAAFESE LQAYKGKGNPEVEWLRWHAAYIRGYLQAYRHN | BCMA | 11.42 |
| 147 | MGSWAEFWDRLDAIDSRLNALGGSEAELAAFEKEIAAFESE LQAYKGKGNPEVEYLREWAAYIRGYLQAYRHN | BCMA | 18.22 |
| 148 | MGSWAEFDLRLRAIAKRLVALGGSEAELAAFEKEIAAFESE LQAYKGKGNPEVEMLRLDAAYIRGVLQAYRHN | BCMA | 4.09 |
| 149 | MGSWSEFWDRLYAIRIRLDALGGSEAELAAFEKEIAAFESE LQAYKGKGNPEVEKLRSVAARIRNWLQAYRHN | BCMA | 12.52 |
| 150 | MGSWSEFWFRLGAIRNRLDALGGSEAELAAFEKEIAAFESE LQAYKGKGNPEVEKLRDVAAHIRHWLQAYRHN | BCMA | 14.93 |
| 151 | MGSWSEFNDRLDAIRWRLDALGGSEAELAAFEKEIAAFESE LQAYKGKGNPEVEWLRQVAATIRYRLQAYRHN | BCMA | 13.59 |
| 152 | MGSWVEFWDRLGAIRERLQALGGSEAELAAFEKEIAAFESE LQAYKGKGNPEVEKLRYTAAAIRHYLQAYRHN | BCMA | 5.22 |
| 153 | MGSWAEFWDRLGAIRERLQALGGSEAELAAFEKEIAAFESE LQAYKGKGNPEVEKLRYTAAAIRHYLQAYRHN | BCMA | |
| 154 | MGSWTEFWDRLGAIRERLQALGGSEAELAAFEKEIAAFESE LQAYKGKGNPEVEKLRYTAAAIRHYLQAYRHN | BCMA | |
| 155 | MGSWVEFWDRLGAIRERLQALGGSEAELAAFEKEIAAFESE LQAYKGKGNPEVEKLKYTAAAIRHYLQAYRHN | BCMA | |
| 156 | MGSWVEFWDRLGAIRERLQALGGSEAELAAFEKEIAAFESE LQAYKGKGNPEVEKLQYTAAAIRHYLQAYRHN | BCMA | |
| 157 | MGSWVEFWDRLGAIRERLQALGGSEAELAAFEKEIAAFESE LQAYKGKGNPEVEKLRYTAAAIKHYLQAYRHN | BCMA | |
| 158 | MGSWAEFWDRLGAIRERLQALGGSEAELAAFEKEIAAFESE LQAYKGKGNPEVEKLQYTAAAIKHYLQAYRHN | BCMA | |
| 159 | MGSWTEFWDRLGAIRERLQALGGSEAELAAFEKEIAAFESE LQAYKGKGNPEVEKLQYTAAAIKHYLQAYRHN | BCMA | |
| 160 | MGSWVEFWDRLGAIRERLEALGGSEAELAAFEKEIAAFESE LQAYKGKGNPEVEKLRYVAAVIRHRLQAYRHN | BCMA | 4.18 |

TABLE 1-continued

Exemplary target-specific binding DDs

| SEQ NO: | D-Domain Sequence | Target | ELISA_avg |
|---|---|---|---|
| 161 | MGSWVEFWDRLGAIRERLQALGGSEAELAAFEKEIAAFESELQAYKGKGNPEVEELRASAAAIRIALQAYRHN | BCMA | 3.07 |
| 162 | MGSWVEFWDRLGAIRDRLDALGGSEAELAAFEKEIAAFESELQAYKGKGNPEVEELRNTAAYIRTFLQAYRHN | BCMA | 16.034 |
| 163 | MGSWSEFWVRLGAIRDRLDALGGSEAELAAFEKEIAAFESELQAYKGKGNPEVEALRVTAAQIRHYLQAYRHN | BCMA | 23.5 |
| 164 | MGSWSEFWVRLGAIRERLDALGGSEAELAAFEKEIAAFESELQAYKGKGNPEVEKLRYTAATIRRFLQAYRHN | BCMA | 7.55667 |
| 165 | MGSWSEFWARLGAIRERLDALGGSEAELAAFEKEIAAFESELQAYKGKGNPEVEKLRYTAATIRRFLQAYRHN | BCMA | |
| 166 | MGSWSEFWVRLGAIRERLDALGGSEAELAAFEKEIAAFESELQAYKGKGNPEVEKLRYTAGTIRRFLQAYRHN | BCMA | |
| 167 | MGSWSEFWVRLGAIRERLDALGGSEAELAAFEKEIAAFESELQAYKGKGNPEVEKLRYTAATIKRFLQAYRHN | BCMA | |
| 168 | MGSWSEFWARLGAIRERLDALGGSEAELAAFEKEIAAFESELQAYKGKGNPEVEKLRYTAGTIKRFLQAYRHN | BCMA | |
| 169 | MGSWSEFWDRLTAIRVRLDALGGSEAELAAFEKEIAAFESELQAYKGKGNPEVEKLRYTAAHIRKFLQAYRHN | BCMA | 16.14 |
| 170 | MGSWTEFWTRLNAIYERLDALGGSEAELAAFEKEIAAFESELQAYKGKGNPEVEKLRFTAASIRMYLQAYRHN | BCMA | 8.43 |
| 171 | MGSWFEFWDRLAAIRDRLEALGGSEAELAAFEKEIAAFESELQAYKGKGNPEVEDLRYVAAKIRVRLQAYRHN | BCMA | 12.78 |
| 172 | MGSWTEFWVRLNAIRDRLEALGGSEAELAAFEKEIAAFESELQAYKGKGNPEVEDLRHTAAIIRNYLQAYRHN | BCMA | 12.53 |
| 173 | MGSWVEFWHRLGAIYDRLEALGGSEAELAAFEKEIAAFESELQAYKGKGNPEVEELRRTAALIRQTLQAYRHN | BCMA | 19.904 |
| 174 | MGSWVEFWNRLGAIYDRLEALGGSEAELAAFEKEIAAFESELQAYKGKGNPEVEKLRHTAAVIRLYLQAYRHN | BCMA | 14.55 |
| 175 | MGSWSEFWERLEAIYDRLYALGGSEAELAAFEKEIAAFESELQAYKGKGNPEVEELRRTAATIRSFLQAYRHN | BCMA | 18.78 |
| 176 | MGSWEEFDNRLEAIFDRLEALGGSEAELAAFEKEIAAFESELQAYKGKGNPEVEELREFAATIRITLQAYRHN | BCMA | 3.93 |
| 177 | MGSWMEFWDRLYAIEFRLFALGGSEAELAAFEKEIAAFESELQAYKGKGNPEVEKLRRVAATIRNELQAYRHN | BCMA | 11.6925 |
| 178 | MGSWTEFWERLYAIEYRLFALGGSEAELAAFEKEIAAFESELQAYKGKGNPEVEKLRSVAATIRYELQAYRHN | BCMA | 12.7 |
| 179 | MGSWNEFWERLYAIELRLFALGGSEAELAAFEKEIAAFESELQAYKGKGNPEVEKLRMTAAYIRNELQAYRHN | BCMA | 9.945 |
| 180 | MGSWYEFWKRLYAIEYRLFALGGSEAELAAFEKEIAAFESELQAYKGKGNPEVEALRKVAAKIREQLQAYRHN | BCMA | 14.785 |
| 181 | MGSWTEFWARLYAIEMRLFALGGSEAELAAFEKEIAAFESELQAYKGKGNPEVEHLRRVAALIREQLQAYRHN | BCMA | 12.46 |
| 182 | MGSWHEFWDRLYAIEFRLFALGGSEAELAAFEKEIAAFESELQAYKGKGNPEVESLRQVAAKIRWHLQAYRHN | BCMA | 7.3 |
| 183 | MGSWDEFEFRLGALRWRLIALGGSEAELAAFEKEIAAFESELQAYKGKGNPEVEYLRFGAAHIRHILQAYRHN | BCMA | 9.2 |
| 184 | MGSWTEFYHRLYAIRERLSALGGSEAELAAFEKEIAAFESELQAYKGKGNPEVEYLRFGAAHIRHLLQAYRHN | BCMA | 9.6275 |
| 185 | MGSWVEFETRLDAIRMRLGALGGSEAELAAFEKEIAAFESELQAYKGKGNPEVEYLRFGAAHIRALLQAYRHN | BCMA | 14.0717 |

TABLE 1-continued

Exemplary target-specific binding DDs

| SEQ NO: | D-Domain Sequence | Target | ELISA_avg |
|---|---|---|---|
| 186 | MGSWGEFDVRLFAIRERLSALGGSEAELAAFEKEIAAFESELQAYKGKGNPEVEYLRGYAAQIRSFLQAYRHN | BCMA | 7.35333 |
| 187 | MGSWVEFDERLSAIRERLDALGGSEAELAAFEKEIAAFESELQAYKGKGNPEVEYLRLYAAQIRVFLQAYRHN | BCMA | 5.61 |
| 188 | MGSWSEFDGRLGAIWDRLYALGGSEAELAAFEKEIAAFESELQAYKGKGNPEVEYLRDRAAQIREFLQAYRHN | BCMA | 10.0305 |
| 189 | MGSWGEFEGRLHAIRSRLSALGGSEAELAAFEKEIAAFESELQAYKGKGNPEVEVLRGYAAWIRALLQAYRHN | BCMA | 6.17 |
| 190 | MGSWGEFNGRLGAIRERLQALGGSEAELAAFEKEIAAFESELQAYKGKGNPEVEFLRAYAASIRAVLQAYRHN | BCMA | 4.95333 |
| 191 | MGSWWEFTFRLAAIEFRLEALGGSEAELAAFEKEIAAFESELQAYKGKGNPEVEDLRAIAAEIRKSLQAYRHN | BCMA | 5.75 |
| 192 | MGSWDEFQFRLAAIGFRLGALGGSEAELAAFEKEIAAFESELQAYKGKGNPEVEVLRRQAARIRHLLQAYRHN | BCMA | 6.155 |
| 193 | MGSWYEFVTRLHAIDHRLKALGGSEADLAAFEKEIAAFESELQAYKGKGNPEVEWLRFYAAGIRMNLQAYRHN | BCMA | 4.12 |
| 194 | MGSWSIEFWRLEAIKFRLIALGGSEAELAAFEKEIAAFESELQAYKGKGNPEVEFLRVEAAAIRRVLQAYRHN | BCMA | 8.43 |
| 195 | MGSWGEFEHRLDPSTCVWLALGGSEAELAAFEKEIAAFESELQAYKGKGNPEVEKLRRGAAVIRHWLQAYRHN | BCMA | 4.05 |
| 196 | MGSWIEFAMRLEAIENRLTALGGSEAELAIFESMIAHFEELLQNYKGKGNPEVEALIHEAFAIHKELWAYRHN | BCMA | 10.73 |
| 197 | MGSWNEFYQRLEAIENRLQALGGSEAELAMFEVRIALFEDMLQGYKGKGNPEVEALKQEAIAILRELIAYRHN | BCMA | 6.01 |
| 198 | MGSWNEFYDRLRAIKKRLYALGGSEAELADFEEDIAQFEVDLQDYKGKGNPEVEALHREAHAITHELWAYRHN | BCMA | 12.36 |
| 199 | MGSWGEFKHRLALIKWYLEALGGSEAELAHFEDWIAVFEVQLQNYKGKGNPEVEALRKEAAAIRDELQAYRHN | BCMA | 17.09 |
| 200 | MGSWYEFKHRLAIIKWYLEALGGSEAELAKFEAWIAEFEMILQRYKGKGNPEVEALRKEAAAIRDELQAYRHN | BCMA | 5.505 |
| 201 | MGSWYEFKHRLAIIKWYLEALGGSEAELAHFEQYIADFEGTLQKYKGKGNPEVEALRKEAAAIRDELQAYRHN | BCMA | 14.8333 |
| 202 | MGSWYNFKHRLAIIKWYLEALGGSEAELARFENFIANFETQLQLYKGKGNPEVEALRKEAAAIRDELQAYRHN | BCMA | 6.7615 |
| 203 | MGSWFQFKHRLAIIKWQLEALGGSEAELAWFEQWIADFEHQLQHYKGKGNPEVEALRKEAAAIRDELQAYRHN | BCMA | 10.39 |
| 204 | MGSWYNFKHRLAIIKWFLEALGGSEAELAVFEVWIADFEHQLQEYKGKGNPEVEALRKEAAAIRDELQAYRHN | BCMA | 16.38 |
| 205 | MGSWDAFKHRLALIKWYLEALGGSEAELAHFEEYIAEFESNLQSYKGKGNPEVEALRKEAAAIRDELQAYRHN | BCMA | 12.98 |
| 206 | MGSWDGFKHRLALIKWYLEALGGSEAELANFENWIAEFEQRLQYYKGKGNPEVEALRKEAAAIRDELQAYRHN | BCMA | 23.62 |
| 207 | MGSWNGFKHRLAIIKWYLEALGGSEAELASFESYIAEFESGLQEYKGKGNPEVEALRKEAAAIRDELQAYRHN | BCMA | 16.53 |
| 208 | MGSWNSFKHRLALIKWYLEALGGSEAELATFEWYIASFESELQQYKGKGNPEVEALRKEAAAIRDELQAYRHN | BCMA | 10.34 |
| 209 | MGSWSDFKYRLAVIKFYLEALGGSEAELASFESFIAHFEDDLQKYKGKGNPEVEALRKEAAAIRDELQAYRHN | BCMA | 13.04 |
| 210 | MGSWSGFKYRLAVIKFYLEALGGSEAELASFELFIAKFEIDLQNYKGKGNPEVEALRKEAAAIRDELQAYRHN | BCMA | 13.066 |

TABLE 1-continued

Exemplary target-specific binding DDs

| SEQ NO: | D-Domain Sequence | Target | ELISA_avg |
|---|---|---|---|
| 211 | MGSWYGFKYRLAVIKWYLEALGGSEAELASFEKYIAHFEHDLQAYKGKGNPEVEALRKEAAAIRDELQAYRHN | BCMA | 9.05 |
| 212 | MGSWYGFKYRLAVIKWYLEALGGSEAELASFEKYIAQFEHDLQAYKGKGNPEVEALRKEAAAIRDELQAYRHN | BCMA | 7.63333 |
| 213 | MGSWYGFKYRLALIKWYLEALGGSEAELASFETYIADFEDLLQAYKGKGNPEVEALRKEAAAIRDELQAYRHN | BCMA | 13.03 |
| 214 | MGSWSTFKYHLAVIKWYLEALGGSEAELASFEDYIAQFETDLQEYKGKGNPEVEALRKEAAAIRDELQAYRHN | BCMA | 11.65 |
| 215 | MGSWHEFKYRLALIKWYLEALGGSEAELATFEHHIAQFEWDLQKYKGKGNPEVEALRKEAAAIRDELQAYRHN | BCMA | 16.19 |
| 216 | MGSWNMFKYRLAHIKWYLEALGGSEAELATFEAYIADFEVDLQKYKGKGNPEVEALRKEAAAIRDELQAYRHN | BCMA | 16.33 |
| 217 | MGSWHGFKYRLAIIKWWLEALGGSEAELAFFEEWIASFERDLQIYKGKGNPEVEALRKEAAAIRDELQAYRHN | BCMA | 6.025 |
| 218 | MGSWHGFKYRLAVIKWYLEALGGSEAELAMFEGWIAQFEITLQQYKGKGNPEVEALRKEAAAIRDELQAYRHN | BCMA | 5.99 |
| 219 | MGSWQGFKYRLAVIKWMLEALGGSEAELAFFENWIAEFETKLQQYKGKGNPEVEALRKEAAAIRDELQAYRHN | BCMA | 7.75 |
| 220 | MGSWSGFKYRLAVIKWYLEALGGSEAELATFEEWIAEFETELQFYKGKGNPEVEALRKEAAAIRDELQAYRHN | BCMA | 13.975 |
| 221 | MGSWGYFKYRLAMIKWYLEALGGSEAELASFESWIAEFEGSLQAYKGKGNPEVEALRKEAAAIRDELQAYRHN | BCMA | 13.018 |
| 222 | MGSWHAFKYKLAMIKWYLEALGGSEAELAHFEEWIAEFEALLQEYKGKGNPEVEALRKEAAAIRDELQAYRHN | BCMA | 11.63 |
| 223 | MGSWQHFKYRLAIIKWYLEALGGSEAELAFFESFIAKFEHDLQKYKGKGNPEVEALRKEAAAIRDELQAYRHN | BCMA | 8.91 |
| 224 | MGSWNDFKYRLAIIKYYLEALGGSEAELAHFESYIASFEHDLQNYKGKGNPEVEALRKEAAAIRDELQAYRHN | BCMA | 15.1233 |
| 225 | MGSWGAFKYRLAIIKFYLEALGGSEAELARFEEFIANFEHDLQNYKGKGNPEVEALRKEAAAIRDELQAYRHN | BCMA | 12.88 |
| 226 | MGSWYNFKYRLAIIKFYLEALGGSEAELAQFEIWIAEFEHDLQGYKGKGNPEVEALRKEAAAIRDELQAYRHN | BCMA | 19.91 |
| 227 | MGSWEQFKYRLAIIKYMLEALGGSEAELAWFESWIANFESDLQHYKGKGNPEVEALRKEAAAIRDELQAYRHN | BCMA | 11.01 |
| 228 | MGSWQQFKYRLAIIKYYLEALGGSEAELAGFETYIAKFEEVLQSYKGKGNPEVEALRKEAAAIRDELQAYRHN | BCMA | 15.12 |
| 229 | MGSWAGFKYRLAVIKYYLEALGGSEAELAHFEQWIAHFEGMLQDYKGKGNPEVEALRKEAAAIRDELQAYRHN | BCMA | 12.68 |
| 230 | MGSWTAFKYRLAIIKFYLEALGGSEAELAHFESYIAHFEDMLQHYKGKGNPEVEALRKEAAAIRDELQAYRHN | BCMA | 7.43 |
| 231 | MGSWAHFKYRLAIIKFWLEALGGSEAELANFEEYIAEFESTLQVYKGKGNPEVEALRKEAAAIRDELQAYRHN | BCMA | 13.12 |
| 232 | MGSWANFKYRLALIKWHLEALGGSEAELASFEIWIADFEESLQWYKGKGNPEVEALRKEAAAIRDELQAYRHN | BCMA | 14.2878 |
| 233 | MGSWATFKYRLALIKWHLEALGGSEAELADFEEYIAGFEEGLQKYKGKGNPEVEALRKEAAAIRDELQAYRHN | BCMA | 15.07 |
| 234 | MGSWTHFKYRLALIKWWLEALGGSEAELAGFEVHIADFEAQLQMYKGKGNPEVEALRKEAAAIRDELQAYRHN | BCMA | 7.36692 |
| 235 | MGSWNTFKYHLAVIKFMLEALGGSEAELAFFEQWIAEFEVTLQSYKGKGNPEVEALRKEAAAIRDELQAYRHN | BCMA | 10.6006 |

TABLE 1-continued

Exemplary target-specific binding DDs

| SEQ NO: | D-Domain Sequence | Target | ELISA_avg |
|---|---|---|---|
| 236 | MGSWTQFKYHLAVIKWYLEALGGSEAELAGFEQWIAEFEKT LQEYKGKGNPEVEALRKEAAAIRDELQAYRHN | BCMA | 21.1178 |
| 237 | MGSWNQFKYRLAVIKFYLEALGGSEAELAHFETWIAAFEEQ LQFYKGKGNPEVEALRKEAAAIRDELQAYRHN | BCMA | 12.85 |
| 238 | MGSWNEFKYHLAVIKFYLEALGGSEAELAHFETWIAEFEYE LQKYKGKGNPEVEALRKEAAAIRDELQAYRHN | BCMA | 13.68 |
| 239 | MGSWVQFKYHLAVIKFYLEALGGSEAELAHFETWIAEFEVA LQGYKGKGNPEVEALRKEAAAIRDELQAYRHN | BCMA | 12.6957 |
| 240 | MGSWVDFKYHLAVIKFWLEALGGSEAELANFETWIANFEQE LQMYKGKGNPEVEALRKEAAAIRDELQAYRHN | BCMA | 13.22 |
| 241 | MGSWVDFKYHLAVIKWYLEALGGSEAELADFENWIAHFESI LQQYKGKGNPEVEALRKEAAAIRDELQAYRHN | BCMA | 10.43 |
| 242 | MGSWVEFKYHLAVIKFTLEALGGSEAELADFEEEIARFEMI LQQYKGKGNPEVEALRKEAAAIRDELQAYRHN | BCMA | 6.92 |
| 243 | MGSWSHFKYHLALIKWYLEALGGSEAELAKFEFWIAEFEHN LQMYKGKGNPEVEALRKEAAAIRDELQAYRHN | BCMA | 7.93 |
| 244 | MGSWYHFKYHLALIKWYLEALGGSEAELAHFEHWIAEFEWT LQQYKGKGNPEVEALRKEAAAIRDELQAYRHN | BCMA | 8.85 |
| 245 | MGSWQGFKYHLALIKFYLEALGGSEAELAHFEHWLAEFEHD LQTYKGKGNPEVEALRKEAAAIRDELQAYRHN | BCMA | 21.2 |
| 246 | MGSWLSFKHHLALIKWYLEALGGSEAELASFEAWIALFEHQ LQQYKGKGNPEVEALRKEAAAIRDELQAYRHN | BCMA | 6.305 |
| 247 | MGSWSEFKYKLALIKWYLEALGGSEAELAHFEGWIANFETT LQKYKGKGNPEVEALRKEAAAIRDELQAYRHN | BCMA | 11.2875 |
| 248 | MGSWIEFKYKLAIIKFYLEALGGSEAELAHFEHWIADFEFV LQQYKGKGNPEVEALRKEAAAIRDELQAYRHN | BCMA | 14.88 |
| 249 | MGSWQNFKYHLAMIKWYLEALGGSEAELANFEEFIAQFEIN LQHYKGKGNPEVEALRKEAAAIRDELQAYRHN | BCMA | 9.55 |
| 250 | MGSWYNFKYHLAIIKWWLEALGGSEAELADFEHYIADFERN LQEYKGKGNPEVEALRKEAAAIRDELQAYRHN | BCMA | 8.62636 |
| 251 | MGSWYQFKYHLAIIKWYLEALGGSEAELAGFENYIATFEQE LQQYKGKGNPEVEALRKEAAAIRDELQAYRHN | BCMA | 18.41 |
| 252 | MGSWSHFKYHLAIIKFYLEALGGSEAELAGFEIWIAKFEDE LQMYKGKGNPEVEALRKEAAAIRDELQAYRHN | BCMA | 9.34 |
| 253 | MGSWVGFKAHLAIIKWYLEALGGSEAELAGFEIFIADFEAL LQMYKGKGNPEVEALRKEAAAIRDELQAYRHN | BCMA | 9.71 |
| 254 | MGSWVNFKYLAIIKYMLEALGGSEAELAFFEDWIAEFERT LQQYKGKGNPEVEALRKEAAAIRDELQAYRHN | BCMA | 7.38951 |
| 255 | MGSWSNFKYRLAVIKYMLEALGGSEAELAFFEDWIADFELH LQVYKGKGNPEVEALRKEAAAIRDELQAYRHN | BCMA | 9.34 |
| 256 | MGSWTNFKYLAVIKFMLEALGGSEAELAFFEDWIAGFEID LQNYKGKGNPEVEALRKEAAAIRDELQAYRHN | BCMA | 11.4075 |
| 257 | MGSWTGFKYRLAIIKFMLEALGGSEAELAFFEQWIADFENE LQYYKGKGNPEVEALRKEAAAIRDELQAYRHN | BCMA | 13.89 |
| 258 | MGSWHNFKYRLAIIKFMLEALGGSEAELAWFENWIADFEDS LQDYKGKGNPEVEALRKEAAAIRDELQAYRHN | BCMA | 13.59 |
| 259 | MGSWFAFKHRLAVIKYMLEALGGSEAELAFFEHWIAQFEHD LQQYKGKGNPEVEALRKEAAAIRDELQAYRHN | BCMA | 11.985 |
| 260 | MGSWYEFKHRLAVIKYMLEALGGSEAELAFFENWIAQFEHE LQTYKGKGNPEVEALRKEAAAIRDELQAYRHN | BCMA | 3.71 |

TABLE 1-continued

Exemplary target-specific binding DDs

| SEQ NO: | D-Domain Sequence | Target | ELISA_avg |
|---|---|---|---|
| 261 | MGSWYKFKHKLAVIKYMLEALGGSEAELAWFEEWIAEFEVT LQDYKGKGNPEVEALRKEAAAIRDELQAYRHN | BCMA | 4.54 |
| 262 | MGSWFYFKQKLAFIKWYLEALGGSEAELANFEIYIAEFEVM LQQYKGKGNPEVEALRKEAAAIRDELQAYRHN | BCMA | 7.23 |
| 263 | MGSWFSFKHHLAVIKWNLEALGGSEAELASFEEQIAEFESV LQAYKGKGNPEVEALRKEAAAIRDELQAYRHN | BCMA | 6.45 |
| 264 | MGSWGNFKYRLAIIKFHLEALGGSEAELATFEAWIANFESM LQNYKGKGNPEVEALRKEAAAIRDELQAYRHN | BCMA | 22.7 |
| 265 | MGSWSYFKYGLAIIKIRLEALGGSEAELADFERWIAAFEHD LQYYKGKGNPEVEALRKEAAAIRDELQAYRHN | BCMA | 13.33 |
| 266 | MGSWSYFKFGLAHIKLRLEALGGSEAELADFEQWIASFEEQ LQTYKGKGNPEVEALRKEAAAIRDELQAYRHN | BCMA | 18.354 |
| 267 | MGSWSYFKWGLAHIKLRLEALGGSEAELADFEFWIAEFEGL LQDYKGKGNPEVEALRKEAAAIRDELQAYRHN | BCMA | 17.64 |
| 268 | MGSWIYFKYGLAHIKTRLEALGGSEAELADFEQWIAEFEKM LQDYKGKGNPEVEALRKEAAAIRDELQAYRHN | BCMA | 21.12 |
| 269 | MGSWGYFKYGLATIKHRLEALGGSEAELADFELWIAKFEEQ LQVYKGKGNPEVEALRKEAAAIRDELQAYRHN | BCMA | 14.01 |
| 270 | MGSWEYFKYGLATIKMHLEALGGSEAELADFEHWIAHFEHQ LQMYKGKGNPEVEALRKEAAAIRDELQAYRHN | BCMA | 18.4033 |
| 271 | MGSWSYFKYGLATIKEKLEALGGSEAELADFETWIAMFEKQ LQEYKGKGNPEVEALRKEAAAIRDELQAYRHN | BCMA | 18.15 |
| 272 | MGSWHYFKNGLAIIKEKLEALGGSEAELADFEIWIAMFEME LQEYKGKGNPEVEALRKEAAAIRDELQAYRHN | BCMA | 19.85 |
| 273 | MGSWQYFKYGLAIIKIKLEALGGSEAELADFEAWIATFEKQ LQHYKGKGNPEVEALRKEAAAIRDELQAYRHN | BCMA | 10.28 |
| 274 | MGSWVYFKHGLAVIKMRLEALGGSEAELADFETWIAQFEMT LQEYKGKGNPEVEALRKEAAAIRDELQAYRHN | BCMA | 21.45 |
| 275 | MGSWVYFKYGLAVIKEKLEALGGSEAELADFETWIAEFEFG LQQYKGKGNPEVEALRKEAAAIRDELQAYRHN | BCMA | 17.58 |
| 276 | MGSWYYFKYGLAVIKGKLEALGGSEAELADFETWIAKFENH LQSYKGKGNPEVEALRKEAAAIRDELQAYRHN | BCMA | 3.84 |
| 277 | MGSWTYFKYGLALIKYRLEALGGSEAELADFEEWIAQFEVS LQHYKGKGNPEVEALRKEAAAIRDELQAYRHN | BCMA | 15.21 |
| 278 | MGSWDYFKYGLALIKIKLEALGGSEAELADFEVWIAQFEMA LQVYKGKGNPEVEALRKEAAAIRDELQAYRHN | BCMA | 15.76 |
| 279 | MGSWTYFKFGLAHIKDSLEALGGSEAELADFEQWIAMFEQD LQVYKGKGNPEVEALRKEAAAIRDELQAYRHN | BCMA | 17.01 |
| 280 | MGSWGYFKHGLAHIKSSLEALGGSEAELADFEVWIAAFENE LQEYKGKGNPEVEALRKEAAAIRDELQAYRHN | BCMA | 18.505 |
| 281 | MGSWGYFKTGLAIIKAQLEALGGSEAELADFELWIAQFEET LQFYKGKGNPEVEALRKEAAAIRDELQAYRHN | BCMA | 12.75 |
| 282 | MGSWAYFKYGLAVIKLHLEALGGSEAELADFERYIAEFEYE LQAYKGKGNPEVEALRKEAAAIRDELQAYRHN | BCMA | 13.44 |
| 283 | MGSWLDFKEGLADIKRSLEALGGSEAELADFEGVIALFEWK LQTYKGKGNPEVEALRKEAAAIRDELQAYRHN | BCMA | 3.03 |
| 284 | MGSWEVFKHELAVIKDYLEALGGSEAELAHFEWGIAWFEGF LQDYKGKGNPEVEALRKEAAAIRDELQAYRHN | BCMA | 9.33 |
| 285 | MGSWIVFKQSLAWIKEHLEALGGSEAELAEFEFYIANFEHT LQNYKGKGNPEVEALRKEAAAIRDELQAYRHN | BCMA | 10.57 |

TABLE 1-continued

Exemplary target-specific binding DDs

| SEQ NO: | D-Domain Sequence | Target | ELISA_avg |
|---|---|---|---|
| 286 | MGSWIYFKDSLAYIKKYLEALGGSEAELATFEYYIANFEHELQYYKGKGNPEVEALRKEAAAIRDELQAYRHN | BCMA | 3.2 |
| 287 | MGSWDHFKYNLAWIKKYLEALGGSEAELATFEWYIANFEKRLQDYKGKGNPEVEALRKEAAAIRDELQAYRHN | BCMA | 9.81 |
| 288 | MGSWFTFKQNLAWIKLHLEALGGSEAELARFEYYIADFENKLQLYKGKGNPEVEALRKEAAAIRDELQAYRHN | BCMA | 14.204 |
| 289 | MGSWREFKYGLAHIKRVLEALGGSEAELAVFEYYIAKFEQELQEYKGKGNPEVEALRKEAAAIRDELQAYRHN | BCMA | 14.7 |
| 290 | MGSWIQFKYGLAHIKRTLEALGGSEAELAVFEWYIADFEQQLQGYKGKGNPEVEALRKEAAAIRDELQAYRHN | BCMA | 8.35667 |
| 291 | MGSWVEFKHNLAWIKVTLEALGGSEAELAVFEYYIAQFEEQLQEYKGKGNPEVEALRKEAAAIRDELQAYRHN | BCMA | 15.83 |
| 292 | MGSWISFKDNLAMIKEFLEALGGSEAELAVFEWYIATFEVELQDYKGKGNPEVEALRKEAAAIRDELQAYRHN | BCMA | 7.16 |
| 293 | MGSWHIFKDNLATIKAFLEALGGSEAELAVFEWYIAKFEEELQGYKGKGNPEVEALRKEAAAIRDELQAYRHN | BCMA | 3.47 |
| 294 | MGSWTSFKHGLAGIKRVLEALGGSEAELATFEWYIAQFERHLQAYKGKGNPEVEALRKEAAAIRDELQAYRHN | BCMA | 9.765 |
| 295 | MGSWQSFKHALADIKINLEALGGSEAELAQFEYAIAVFEYRLQAYKGKGNPEVEALRKEAAAIRDELQAYRHN | BCMA | 13.7188 |
| 296 | MGSWHTFKEALAQIKGELEALGGSEAELASFEYAIAVFEYRLQMYKGKGNPEVEALRKEAAAIRDELQAYRHN | BCMA | 6.76 |
| 297 | MGSWTDFKTSLADIKAELEALGGSEAELAKFEYYIAIFEYRLQEYKGKGNPEVEALRKEAAAIRDELQAYRHN | BCMA | 18.76 |
| 298 | MGSWTNFKEGLAEIKRDLEALGGSEAELARFEYVIAVFEFRLQNYKGKGNPEVEALRKEAAAIRDELQAYRHN | BCMA | 12.3267 |
| 299 | MGSWHTFKDGLAEIKSELEALGGSEAELAMFEYVIAIFEYRLQNYKGKGNPEVEALRKEAAAIRDELQAYRHN | BCMA | 10.65 |
| 300 | MGSWQFFKEHLASIKFWLEALGGSEAELAFFEDAIADFEYHLQNYKGKGNPEVEALRKEAAAIRDELQAYRHN | BCMA | 10.58 |
| 301 | MGSWTYFKEHLASIKFWLEALGGSEAELAFFEDAIAEFEKDLQYYKGKGNPEVEALRKEAAAIRDELQAYRHN | BCMA | 6.59507 |
| 302 | MGSWIIFKGYLAHIKHHLEALGGSEAELADFEFYIAIFEMELQKYKGKGNPEVEALRKEAAAIRDELQAYRHN | BCMA | 5.18 |
| 303 | MGSWYLFQSHLAHIKHHLEALGGSEAELAWFEFTIAGFEQELQHYKGKGNPEVEALRKEAAAIRDELQAYRHN | BCMA | 7.69 |
| 304 | MGSWYSFKWTLARIKLELEALGGSEAELAYFENVIAHFEMELQSYKGKGNPEVEALRKEAAAIRDELQAYRHN | BCMA | 4.05 |
| 305 | MGSWTTLKWRLAHIKQHLEALGGSEAELALFEYDIAHFEELLQYYKGKGNPEVEALRKEAAAIRDELQAYRHN | BCMA | 17.82 |
| 306 | MGSWYGFKWYLATIKKHLEALGGSEAELALFETEIATFELWLQDYKGKGNPEVEALRKEAAAIRDELQAYRHN | BCMA | 10.65 |
| 307 | MGSWIEFNMRVLAIEDRLWALGGSEAELAAFEKEIAAFESELQAYKGKGNPEVESLRYEACLDPWSSAAYRHN | CD123 | 3.2 |
| 308 | MGSWIEFHERLWAIEDRLWALGGSEAELAAFEKEIAAFESELQAYKGKGNPEVESLREMAASIRHGLQAYRHN | CD123 | 3.4 |
| 309 | MGSWFEFYERLWAIDDRLWALGGSEAELAAFEKEIAAFESELQAYKGKGNPEVEWLREEAASIRSSLQAYRHN | CD123 | 6 |
| 310 | MGSWFEFWDRLEAIDDRLFALGGSEAELAAFEKEIAAFESELQAYKGKGNPEVESLRYNAAEIRKELQAYRHN | CD123 | 4.9 |

TABLE 1-continued

Exemplary target-specific binding DDs

| SEQ NO: | D-Domain Sequence | Target | ELISA_avg |
|---|---|---|---|
| 311 | MGSWHEFWSRLDAIDDRLFALGGSEAELAAFEKEIAAFESE LQAYKGKGNPEVEYLRGAAADIRAELQAYRHN | CD123 | 3.8 |
| 312 | MGSWYEFWIRLEAIDDRLFALGGSEAELAAFEKEIAAFESE LQAYKGKGNPEVDILRDFAADIRTELQAYRHN | CD123 | 10.4 |
| 313 | MGSWHEFWDRLEAIDDRLYALGGSEAELAAFEKEIAAFESE LQAYKGKGNPEVEFLREEAAYIRELLQAYRHN | CD123 | 10.6 |
| 314 | MGSWEEFWDRLFAIDDRLWALGGSEAELAAFEKEIAAFESE LQAYKGKGNPEVETLRNEAAEIRMALQAYRHN | CD123 | 3.1 |
| 315 | MGSWWEFDDRLFAIDTRLMALGGSEAELAAFEKEIAAFESE LQAYKGKGNPEVESLREWAATIRMELQAYRHN | CD123 | 3.5 |
| 316 | MGSWTEFHDRLEAIDDRLWALGGSEAELAAFEKEIAAFESE LQAYKGKGNPEVEYLREEAAQIRWELQAYRHN | CD123 | 5.8 |
| 317 | MGSWAEFEDRLWAIEDRLWALGGSEAELAAFEKEIAAFESE LQAYKGKGNPEVEYLREEAAAIRFELQAYRHN | CD123 | 6.2 |
| 318 | MGSWVEFWFRLEAIDSRLWALGGSEAELAAFEKEIAAFESE LQAYKGKGNPEVEWLREEAAAIREDLQAYRHN | CD123 | 3.2 |
| 319 | MGSWVEFWQRLEAIESRLWALGGSEAELAAFEKEIAAFESE LQAYKGKGNPEVEFLREEAAEIRWELQAYRHN | CD123 | 7.7 |
| 320 | MGSWSEFWQRLEAIEDRLWALGGSEAELAAFEKEIAAFESE LQAYKGKGNPEVEWLRENAAMIRDELQAYRHN | CD123 | 4.7 |
| 321 | MGSWSEFITRLEAIDDRLWALGGSEAELAAFEKEIAAFESE LQAYKGKGNPEVEILREEAAEIRQHLQAYRHN | CD123 | 3.3 |
| 322 | MGSWYEFETRLEAIYDRLWALGGSEAELAAFEKEIAAFESE LQAYKGKGNPEVELLRVEAAEIREDLQAYRHN | CD123 | 3.2 |
| 323 | MGSWTEFYYRLEAIEDRLWALGGSEAELAAFEKEIAAFESE LQAYKGKGNPEVEFLRVEAANIRDMLQAYRHN | CD123 | 7.5 |
| 324 | MGSWYEFVIRLEAIEDRLWALGGSEAELAAFEKEIAAFESE LQAYKGKGNPEVEVLRWYAADIRHELQAYRHN | CD123 | 6.4 |
| 325 | MGSWTEFSIRLEAIYDRLVALGGSEAELAAFEKEIAAFESE LQAYKGKGNPEVEVLRTYAANIRHELQAYRHN | CD123 | 11.9 |
| 326 | MGSWTEFSIRLEAIYDRLVALGGSEAELAAFEKEIAAFESE LQAYKGKGNPEVEVLRTYAAFIRHELQAYRHN | CD123 | 10.2 |
| 327 | MGSWTEFVWRLEAIWDRLDALGGSEAELAAFEKEIAAFESE LQAYKGKGNPEVEVLREDAAVIRHFLQAYRHN | CD123 | 3.6 |
| 328 | MGSWVEFHERLEAIEDRLMALGGSEAELAAFEKEIAAFESE LQAYKGKGNPEVEYLREDAAFIRQLLQAYRHN | CD123 | 3.7 |
| 329 | MGSWVEFHDRLEAIEDRLYALGGSEAELAAFEKEIAAFESE LQAYKGKGNPEVEWLREDAAYIRSILQAYRHN | CD123 | 4.6 |
| 330 | MGSWIEFYDRLEAIYDRLDALGGSEAELAAFEKEIAAFESE LQAYKGKGNPEVEWLREDAAFIRSWLQAYRHN | CD123 | 7.5 |
| 331 | MGSWVEFDQRLEAIYDRLYALGGSEAELAAFEKEIAAFESE LQAYKGKGNPEVEWLREDAAQIRKWLQAYRHN | CD123 | 5.1 |
| 332 | MGSWVEFHDRLEAIEDRLLALGGSEAELAAFEKEIAAFESE LQAYKGKGNPEVEDLREYAAGIRWFLQAYRHN | CD123 | 3.3 |
| 333 | MGSWEEFAQRLYAIEWRLYALGGSEAELAAFEKEIAAFESE LQAYKGKGNPEVEVLRYVAAQIRYHLQAYRHN | CD123 | 16.9 |
| 334 | MGSWDEFAWRLDVIFARLGALGGSEAELAAFEKEIAAFESE LQAYKGKGNPEVEELRKNAAQIRDGLQAYRHN | CD123 | 4.6 |
| 335 | MGSWDEFYYRLEAIEMRLGALGGSEAELAAFEKEIAAFESE LQAYKGKGNPEVEELRHYAAQIRHMLQAYRHN | CD123 | 7.2 |

TABLE 1-continued

Exemplary target-specific binding DDs

| SEQ NO: | D-Domain Sequence | Target | ELISA_avg |
|---|---|---|---|
| 336 | MGSWEEFYDRLEAIYNRLGALGGSEAELAAFEKEIAAFESE<br>LQAYKGKGNPEVEVLREYAADIREMLQAYRHN | CD123 | 18.6 |
| 337 | MGSWDEFGRRLYAIEWQLYALGGEEAELAAFEKEIAAFESE<br>LQAYKGKGNPEVEALRKEAAVIRENLQAYRHN | CD123 | |
| 338 | MGSWDEFGRRLYAIEWQLYALGGTEAELAAFEKEIAAFESE<br>LQAYKGKGNPEVEALRKEAAVIRENLQAYRHN | CD123 | |
| 339 | MGSWDEFGRRLYAIETQLYALGGEEAELAAFEKEIAAFESE<br>LQAYKGKGNPEVEKLREIAAVIRENLQAYRHN | CD123 | |
| 340 | MGSWDEFGRRLYAIEWQLYALGGEEAELAAFEKEIAAFESE<br>LQAYKGKGNPEVEKLREIAAVIRENLQAYRHN | CD123 | |
| 341 | MGSWDEFGRRLYAIKWQLYALGGEEAELAAFEKEIAAFESE<br>LQAYKGKGNPEVEKLREIAAVIRENLQAYRHN | CD123 | |
| 342 | MGSWDEFGRRLYAIEWQLYALGGEEAELAAFEKEIAAFESE<br>LQAYKGKGNPEVEKLRKIAAVIRENLQAYRHN | CD123 | |
| 343 | MGSWDEFGRRLYAIEWQLYALGGGEAELAAFEKEIAAFESE<br>LQAYKGKGNPEVEKLREIAAVIRENLQAYRHN | CD123 | |
| 344 | MGSWDEFGRRLYAIEWQLYALGGTEAELAAFEKEIAAFESE<br>LQAYKGKGNPEVEKLREIAAVIRENLQAYRHN | CD123 | |
| 345 | MGSWDEFGRRLYAIEWQLYALGGGEAELAAFEKEIAAFESE<br>LQAYKGKGNPEVEKLREIAAVIRSNLQAYRHN | CD123 | |
| 346 | MGSWDEFGRRLYAIEWQLYALGGTEAELAAFEKEIAAFESE<br>LQAYKGKGNPEVEKLREIAAVIRSNLQAYRHN | CD123 | |
| 347 | MGSWDEFGRRLYAIEWQLYALGGEEAELAAFEKEIAAFESE<br>LQAYKGKGNPEVEKLREIAAVIRSNLQAYRHN | CD123 | |
| 348 | MGSWDEFGRRLAAIEWQLYALGGEEAELAAFEKEIAAFESE<br>LQAYKGKGNPEVEKLREIAAVIRENLQAYRHN | CD123 | |
| 349 | MGSWDEFGRRLYAIEWQLYALGGEEAELAAFEKEIAAFESE<br>LQAYKGKGNPEVEALREIAAVIRENLQAYRHN | CD123 | |
| 350 | MGSWDEFGRRLYAIEWQLYALGGEEAELAAFEKEIAAFESE<br>LQAYKGKGNPEVEKLREEAAVIRENLQAYRHN | CD123 | |
| 351 | MGSWDEFGRRLYAIEWRLYALGGSEAELAAFEKEIAAFESE<br>LQAYKGKGSPEVEKLREIAAVIRSNLQAYRHN | CD123 | |
| 352 | MGSWDEFGRRLYAIEWRLYALGGSEAELAAFEKEIAAFESE<br>LQAYKGKGNPEVEKLREIAAVIRSNLQAYRHN | CD123 | 5.8 |
| 353 | MGSWDEFGRRLYAIEWRLYALGGEEAELAAFEKEIAAFESE<br>LQAYKGKGNPEVEKLREIAAVIRSNLQAYRHN | CD123 | |
| 354 | MGSWDEFGRRLYAIEWQLYALGGSEAELAAFEKEIAAFESE<br>LQAYKGKGNPEVEKLREIAAVIRSNLQAYRHN | CD123 | |
| 355 | MGSWDEFSRRLYAIEWRLYALGGSEAELAAFEKEIAAFESE<br>LQAYKGKGNPEVEKLREIAAVIRSNLQAYRHN | CD123 | |
| 356 | MGSWDEFGRRLYAIEWRLYALGGSEAELAAFEKEIAAFESE<br>LQAYKGKGNPEVEKLREIAAVIRENLQAYRHN | CD123 | |
| 357 | MGSWDEFGRRLAAIKTQLAALGGEEAELAAFEKEIAAFESE<br>LQAYKGKGNPEVEKLREIAAVIRENLQAYRHN | CD123 | |
| 358 | MGSWDEFGRRLAAIKTQLAALGGTEAELAAFEKEIAAFESE<br>LQAYKGKGNPEVEKLREIAAVIRENLQAYRHN | CD123 | |
| 359 | MGSWDEFGRRLAAIKTQLAALGGEEAELAAFEKEIAAFESE<br>LQAYKGKGNPEVEALRKEAAVIRENLQAYRHN | CD123 | |
| 360 | MGSWDEFGRRLAAIKTQLAALGGTEAELAAFEKEIAAFESE<br>LQAYKGKGNPEVEALRKEAAVIRENLQAYRHN | CD123 | |

TABLE 1-continued

Exemplary target-specific binding DDs

| SEQ NO: | D-Domain Sequence | Target | ELISA_avg |
|---|---|---|---|
| 361 | MGSWDEFEQRLIAIEERLFALGGSEAELAAFEKEIAAFESELQAYKGKGNPEVEWLREEAAVIRKYLQAYRHN | CD123 | 5.9 |
| 362 | MGSWVEFDQRLGAIWDRLVALGGSEAELAAFEKEIAAFESELQAYKGKGNPEVEHLRQGAAVIRDDLQAYRHN | CD123 | 5.3 |
| 363 | MGSWVEFDMRLSAIWERLIALGGSEAELAAFEKEIAAFESELQAYKGKGNPEVEWLREDAAEIREFLQAYRHN | CD123 | 3.3 |
| 364 | MGSWVEFDQRLDAIYERLYALGGSEAELAAFEKEIAAFESELQAYKGKGNPEVEWLRDEAAEIREHLQAYRHN | CD123 | 10.5 |
| 365 | MGSWHEFDQRLWAIEERLWALGGSEAELAAFEKEIAAFESELQAYKGKGNPEVETLRLYAALIRHDLQAYRHN | CD123 | 3.3 |
| 366 | MGSWVEFWDRLDAIEGRLWALGGSEAELAAFEKEIAAFESELQAYKGKGNPEVEDLRWLAAEIRADLQAYRHN | CD123 | 3.5 |
| 367 | MGSWVEFYSRLDAIEDRLWALGGSEAELAAFEKEIAAFESELQAYKGKGNPEVEWLRIAAASIREDLQAYRHN | CD123 | 9.4 |
| 368 | MGSWYEFYERLDAIEERLWALGGSEAELAAFEKEIAAFESELQAYKGKGNPEVEVLRDWAAWIREDLQAYRHN | CD123 | 8.4 |
| 369 | MGSWFEFDDRLWAIENRLWALGGSEAELAAFEKEIAAFESELQAYKGKGNPEVEVLRDNAAWIREILQAYRHN | CD123 | 4.2 |
| 370 | MGSWYEFWDRLDALEDRLWALGGSEAELAAFEKEIAAFESELQAYKGKGNPEVEYLRDSAAFIREELQAYRHN | CD123 | 9.7 |
| 371 | MGSWMEFVDRLDAIESRLWALGGSEAELAAFEKEIAAFESELQAYKGKGNPEVEWLRIEAAFIREELQAYRHN | CD123 | 5.8 |
| 372 | MGSWDEFVDRLWAIEERLWALGGSEAELAAFEKEIAAFESELQAYKGKGNPEVEELRIQAAIIREALQAYRHN | CD123 | 6 |
| 373 | MGSWFEFNYRLGAIEDRLWALGGSEAELAAFEKEIAAFESELQAYKGKGNPEVEMLRQIAAEIREFLQAYRHN | CD123 | 6.9 |
| 374 | MGSWEEFFTRLDAINERLEALGGSEAELAAFEKEIAAFESELQAYKGKGNPEVEMLRYEAAEIRHMLQAYRHN | CD123 | 3.9 |
| 375 | MGSWYEFSNRLDAIGERLWALGGSEAELAAFEKEIAAFESELQAYKGKGNPEVEILRHQAAEIRWFLQAYRHN | CD123 | 3.9 |
| 376 | MGSWYEFWGRLDAIEERLWALGGSEAELAAFEKEIAAFESELQAYKGRGNPEVEMLREDAAEIRGQLQAYRHN | CD123 | 5.4 |
| 377 | MGSWVEFWDRLWAIDYRLFALGGSEAELAAFEKEIAAFESELQAYKGKGNPEVEALRDEAAWIREELQAYRHN | CD123 | 3.6 |
| 378 | MGSWVEFVDRLWAIDERLDALGGSEAELAAFEKEIAAFESELQAYKGKGNPEVEFLRTWAAWIREDLQAYRHN | CD123 | 3.2 |
| 379 | MGSWFEFWDRLEAIWERLDALGGSEAELAAFEKEIAAFESELQAYKGKGNPEVEELRREAAIIREDLQAYRHN | CD123 | 10.3 |
| 380 | MGSWFEFEDRLEAIYQRLDALGGSEAELAAFEKEIAAFESELQAYKGKGNPEVEWLRDEAAWIRSDLQAYRHN | CD123 | 5.5 |
| 381 | MGSWFEFHDRLWAIDERLWALGGSEAELAAFEKEIAAFESELQAYKGKGNPEVEILREEAADIRLDLQAYRHN | CD123 | 3.5 |
| 382 | MGSWYEFEDRLWAIDNRLWALGGSEAELAAFEKEIAAFESELQAYKGKGNPEVEELRVHAADIRDDLQAYRHN | CD123 | 4.9 |
| 383 | MGSWFEFQDRLWAIDNRLWALGGSEAELAAFEKEIAAFESELQAYKGKGNPEVEELRDHAAMIRWELQAYRHN | CD123 | 3.2 |
| 384 | MGSWDEFEERLFAIDERLWALGGSEAELAAFEKEIAAFESELQAYKGKGNPEVEALRYLAADIREELQAYRHN | CD123 | 5 |
| 385 | MGSWEEFWERLDAIDTRLWALGGSEAELAAFEKEIAAFESELQAYKGKGNPEVEVLRNDAADIREPLQAYRHN | CD123 | 6.8 |

TABLE 1-continued

Exemplary target-specific binding DDs

| SEQ NO: | D-Domain Sequence | Target | ELISA_avg |
|---|---|---|---|
| 386 | MGSWMEFWERLEAIDMRLWALGGSEAELAAFEKEIAAFESELQAYKGKGNPEVEYLRDDAAVIRDDLQAYRHN | CD123 | 4.2 |
| 387 | MGSWLEFMWRLDAIDERLWALGGSEAELAAFEKEIAAFESELQAYKGKGNPEVELLREMAAAIRDDLQAYRHN | CD123 | 5.1 |
| 388 | MGSWTEFYNRLDAIDQRLWALGGSEAELAAFEKEIAAFESELQAYKGKGNPEVEMLREYAADIRTDLQAYRHN | CD123 | 3.3 |
| 389 | MGSWWEFIWRLEAIEQRLWALGGSEAELAAFEKEIAAFESELQAYKGKGNPEVEVLRSRAADIRTDLQAYRHN | CD123 | 4 |
| 390 | MGSWSEFYDRLWAIEERLFALGGSEAELAAFEKEIAAFESELQAYKGKGNPEVEYLRYYAAEIREELQAYRHN | CD123 | 17 |
| 391 | MGSWSEFEDRLWAIDQRLFALGGSEAELAAFEKEIAAFESELQAYKGKGNPEVEWLRAYAADIRWELQAYRHN | CD123 | 4.2 |
| 392 | MGSWTEFWERLNAIDERLFALGGSEAELAAFEKEIAAFESELQAYKGKGNPEVEWLRLYAAEIRSELQAYRHN | CD123 | 4 |
| 393 | MGSWWEFEERLWAIDYRLHALGGSEAELAAFEKEIAAFESELQAYKGKGNPEVEMLRSWAAEIRALLQAYRHN | CD123 | 4.1 |
| 394 | MGSWWEFENRLWAIEERLEALGGSEAELAAFEKEIAAFESELQAYKGKGNPEVEMLRNYAAEIRWELQAYRHN | CD123 | 5.6 |
| 395 | MGSWVEFEERLWAIDERLGALGGSEAELAAFEKEIAAFESELQAYKGKGNPEVEWLRDWAADIRWWLQAYRHN | CD123 | 4.1 |
| 396 | MGSWVEFEERLEAIEERLFALGGSEAELAAFEKEIAAFESELQAYKGKGNPEVEWLRDDAANIRHWLQAYRHN | CD123 | 3.8 |
| 397 | MGSWMEFEERLWAIDSRLWALGGSEAELAAFEKEIAAFESELQAYKGKGNPEVEWLRSEAAWIRMELQAYRHN | CD123 | 3.2 |
| 398 | MGSWSEFEHRLEAIESRLFALGGSEAELAAFEKEIAAFESELQAYKGKGNPEVEDLRSEAAWIREQLQAYRHN | CD123 | 7.6 |
| 399 | MGSWFEFWERLDAIEWRLWALGGSEAELAAFEKEIAAFESELQAYKGKGNPEVEELRSTAADIRRYLQAYRHN | CD123 | 3.4 |
| 400 | MGSWFEFWGRLEAIESRLKALGGSEAELAAFEKEIAAFESELQAYKGKGNPEVEELREHAAWIRAYLQAYRHN | CD123 | 4.9 |
| 401 | MGSWQEFTMRLDAIYNRLETLGGSEAELAAFEKEIAAFESELQAYKGKGNPEVEWLRQSAANIRSELQAYRHN | CD123 | 13.7 |
| 402 | MGSWSEFNMRLDAIYERLTALGGSEAELAAFEKEIAAFESELQAYKGKGNPEVEWLRHSAARIRLELQAYRHN | CD123 | 13.7 |
| 403 | MGSWSEFNMRLDAIYERLTALGGSEAELAAFEKEIAAFESELQAYKGKGNPEVEWLRHSAALIRLELQAYRHN | CD123 | 11.4 |
| 404 | MGSWIEFNMRLDAIYERLVALGGSEAELAAFEKEIAAFESELQAYKGKGNPEVEWLRKVAANIRLELQAYRHN | CD123 | 11.4 |
| 405 | MGSWYEFHHRLDAIYERLLALGGSEAELAAFEKEIAAFESELQAYKGKGNPEVEWLRSSAANIRKELQAYRHN | CD123 | 11.9 |
| 406 | MGSWYEFAKRLDAIYERLVALGGSEAELAAFEKEIAAFESELQAYKGKGNPEVEWLRSSAANIREELQAYRHN | CD123 | 15.3 |
| 407 | MGSWTEFYVRLDAIYERLDALGGSEAELAAFEKEIAAFESELQAYKGKGNPEVEWLRMVAANIRTELQAYRHN | CD123 | 16 |
| 408 | MGSWVEFYTRLDAIYGRLDALGGSEAELAAFEKEIAAFESELQAYKGKGNPEVEWLRQVAANIRMELQAYRHN | CD123 | 14.4 |
| 409 | MGSWVEFHMRLDAIYERLDALGGSEAELAAFEKEIAAFESELQAYKGKGNPEVEWLRTAAANIRVELQAYRHN | CD123 | 9.1 |
| 410 | MGSWYEFAIRLDAIYERLHALGGSEAELAAFEKEIAAFESELQAYKGKGNPEVEYLRVWAANIRTELQAYRHN | CD123 | 25.5 |

TABLE 1-continued

Exemplary target-specific binding DDs

| SEQ NO: | D-Domain Sequence | Target | ELISA_avg |
|---|---|---|---|
| 411 | MGSWNEFVIRLDAIYERLLALGGSEAELAAFEKEIAAFESELQAYKGKGNPEVEYLRMAAANIRMELQAYRHN | CD123 | 16.6 |
| 412 | MGSWSEFYVRVDAIYARLSALGGSEAELAAFEKEIAAFESELQAYKGKGNPEVEKLRVWAANIRHELQAYRHN | CD123 | 14.7 |
| 413 | MGSWSEFHVRLDAIYARLDALGGSEAELAAFEKEIAAFESELQAYKGKGNPEVERLREWAANIRRELQAYRHN | CD123 | 14.4 |
| 414 | MGSWVEFHLRLDAIYGRLMALGGSEAELAAFEKEIAAFESELQAYKGKGNPEVENLRVWAANIRNELQAYRHN | CD123 | 17.5 |
| 415 | MGSWVEFEMRLDAIVGRLYALGGSEAELAAFEKEIAAFESELQAYKGKGNPEVEKLRRWAANIRSELQAYRHN | CD123 | 25.3 |
| 416 | MGSWVEFNIRLDAIYERLYALGGSEAELAAFEKEIAAFESELQAYKGKGNPEVEKLRHWAASIRRELQAYRHN | CD123 | 13.4 |
| 417 | MGSWHEFGVRLDAIYDRLMALGGSEAELAAFEKEIAAFESELQAYKGKGNPEVEFLRQAAANIRSELQAYRHN | CD123 | 15.6 |
| 418 | MGSWTEFNLRLDAIYDRLMALGGSEAELAAFEKEIAAFESELQAYKGKGNPEVEWLRASAAAIRVELQAYRHN | CD123 | 14.4 |
| 419 | MGSWTEFNLRLDAIYGRLSALGGSEAELAAFEKEIAAFESELQAYKGKGNPEVEFLRAAAANIRVELQAYRHN | CD123 | 19.3 |
| 420 | MGSWVEFNWRLDAIYDRLVALGGSEAELAAFEKEIAAFESELQAYKGKGNPEVEWLRVSAAKIRGELQAYRHN | CD123 | 9.3 |
| 421 | MGSWNEFAWRLDAIYSRLAALGGSEAELAAFEKEIAAFESELQAYKGKGNPEVEWLRVAAANIRYELQAYRHN | CD123 | 17.7 |
| 422 | MGSWTEFAWRLDAIYDRLLALGGSEAELAAFEKEIAAFESELQAYKGKGNPEVEWLRHVAANIRRELQAYRHN | CD123 | 16.1 |
| 423 | MGSWVEFSIRLDAIYTRLVALGGSEAELAAFEKEIAAFESELQAYKGKGNPEVEMLRKGAANIRKELQAYRHN | CD123 | 15.1 |
| 424 | MGSWVEFYIRLDAIYVRLMALGGSEAELAAFEKEIAAFESELQAYKGKGNPEVEKLRSYAANIRQELQAYRHN | CD123 | 16.1 |
| 425 | MGSWYEFSMRLDAIYDRLMALGGSEAELAAFEKEIAAFESELQAYKGKGNPEVEQLRGYAANIRNELQAYRHN | CD123 | 13 |
| 426 | MGSWVEFIYRLDAIYDRLEALGGSEAELAAFEKEIAAFESELQAYKGKGNPEVEVLRRYAANIRNELQAYRHN | CD123 | 17 |
| 427 | MGSWIEFEVRLDAIYNRLAALGGSEAELAAFEKEIAAFESELQAYKGKGNPEVERLRRYAANIRHELQAYRHN | CD123 | 20.8 |
| 428 | MGSWFEFYDRLDAIYMRLIALGGSEAELAAFEKEIAAFESELQAYKGKGNPEVEVLRRYAANIRAELQAYRHN | CD123 | 13.6 |
| 429 | MGSWFEFYMRLDAIYDRLTALGGSEAELAAFEKEIAAFESELQAYKGKGNPEVERLRTFAANIRKELQAYRHN | CD123 | 13.1 |
| 430 | MGSWYEFDYRLDAIYDRLAALGGSEAELAAFEKEIAAFESELQAYKGKGNPEVERLRKWAANIREELQAYRHN | CD123 | 24.9 |
| 431 | MGSWSEFYLRLDAIYDRLDALGGSEAELAAFEKEIAAFESELQAYKGKGNPEVEWLRKTAANIREELQAYRHN | CD123 | 15.7 |
| 432 | MGSWFEFYERLDAINWRLFALGGSEAELAAFEKEIAAFESELQAYKGKGNPEVEALRGEAAAIREDLQAYRHN | CD123 | 3 |
| 433 | MGSWNEFEDRLDAIWWRLFALGGSEAELAAFEKEIAAFESELQAYKGKGNPEVEALRVEAAFIRTMLQAYRHN | CD123 | 5.1 |
| 434 | MGSWFYFKDDLADINYMLEALGGSEAELAMFEDDIAGFELTLLKYKGKGNPEVEALRKEAAAIRDELQAYRHN | CD123 | 3.7 |
| 435 | MGSWHFFKDDLAWIKNELEALGGSEAELAMFEDDIAMFETMLQSYKGKGNPEVEALRKEAAAIRDELQAYRHN | CD123 | 3.2 |

TABLE 1-continued

Exemplary target-specific binding DDs

| SEQ NO: | D-Domain Sequence | Target | ELISA_avg |
|---|---|---|---|
| 436 | MGSWHWFKTDLADIKEELEALGGSEAELAMFEDDIAEFEEFLQMYKGKGNPEVEALRKEAAAIRDELQAYRHN | CD123 | 3.5 |
| 437 | MGSWWLFKDDLAEIKYWLEALGGSEAELAFFEDDIAEFERGLQIYKGKGNPEVEALRKEAAAIRDELQAYRHN | CD123 | 3.3 |
| 438 | MGSWYEFKDDLAEIKEWLEALGGSEAELAFFELDIADFEWLLQLYKGKGNPEVEALRKEAAAIRDELQAYRHN | CD123 | 3.8 |
| 439 | MGSWQWFKDDLAYIKETLEALGGSEAELALFEDMIADFEFELQWYKGKGNPEVEALRKEAAAIRDELQAYRHN | CD123 | 6.3 |
| 440 | MGSWILFKDDLAWIKETLEALGGSEAELAFFEDNIADFEEQLQGYKGKGNPEVEALRKEAAAIRDELQAYRHN | CD123 | 6 |
| 441 | MGSWIVFKDDLADIKRWLEALGGSEAELAMFEDEIADFEWQLQDYKGKGNPEVEALRKEAAAIRDELQAYRHN | CD123 | 3.9 |
| 442 | MGSWGHFKQDLAWIKDTLEALGGSEAELAFFEDDIAMFEMELQDYKGKGNPEVEALRKEAAAIRDELQAYRHN | CD123 | 4.9 |
| 443 | MGSWGYFKDDLAWIKGELEALGGSEAELAEFEWFIAVFEEDLQVYKGKGNPEVEALRKEAAAIRDELQAYRHN | CD123 | 4.5 |
| 444 | MGSWYWFKDDLAEIKGLLEALGGSEAELAEFEDEIAVFEQELQEYKGKGNPEVEALRKEAAAIRDELQAYRHN | CD123 | 10.4 |
| 445 | MGSWMFFKEDLADIKWALEALGGSEAELAFFEEEIALFEQHLQQYKGKGNPEVEALRKEAAAIRDELQAYRHN | CD123 | 3.2 |
| 446 | MGSWTFFKEDLAGIKWELEALGGSEAELAWFEDEIALFEEELQEYKGKGNPEVEALRKEAAAIRDELQAYRHN | CD123 | 7 |
| 447 | MGSWVFFKDDLADIKDELEALGGSEAELAFFEIAIALFEWELQEYKGKGNPEVEALRKEAAAIRDELQAYRHN | CD123 | 8.8 |
| 448 | MGSWTFFKNDLAEIKDWLEALGGSEAELADFEWDIAEFEYSLQEYKGKGNPEVEALRKEAAAIRDELQAYRHN | CD123 | 3.9 |
| 449 | MGSWTYFKDDLADIKQWLEALGGSEAELAFFEIEIAEFEEELQEYKGKGNPEVEALRKEAAAIRDELQAYRHN | CD123 | 4.6 |
| 450 | MGSWTVFKYDLADIKWWLEALGGSEAELADFEEEIAEFEEELQEYKGKGNPEVEALRKEAAAIRDELQAYRHN | CD123 | 3.9 |
| 451 | MGSWYWFKQDLAHIKSMLEALGGSEAELAWFEEDIADFESELQEYKGKGNPEVEALRKEAAAIRDELQAYRHN | CD123 | 3.3 |
| 452 | MGSWTFFKWDLADIKANLEALGGSEAELAWFEEDLAGFEAELQEYKGKGNPEVEALRKEAAAIRDELQAYRHN | CD123 | 4.8 |
| 453 | MGSWSFFKEELANIQVYLEALGGSEAELAWFEEDIADFEEDLQHYKGKGNPEVEALRKEAAAIRDELQAYRHN | CD123 | 3.8 |
| 454 | MGSWEFFKYELADIKDELEALGGSEAELAWFEEDIATFEEWLQGYKGKGNPEVEALRKEAAAIRDELQAYRHN | CD123 | 3.4 |
| 455 | MGSWQTFKDELAHIKWELEALGGSEAELAWFEWDIANFEEELQEYKGKGNPEVEALRKEAAAIRDELQAYRHN | CD123 | 5.5 |
| 456 | MGSWYWFKEELAFIKWELEALGGSEAELALFEEDIAYFEEMLQEYKGKGNPEVEALRKEAAAIRDELQAYRHN | CD123 | 9.4 |
| 457 | MGSWNSFKDELAEIKAELEALGGSEAELAFFEEDIAWFEEHLQQYKGKGNPEVEALRKEAAAIRDELQAYRHN | CD123 | 3.3 |
| 458 | MGSWDLFKWELAEIKLGLEALGGSEAELAEFEYDIAWFEEDLQDYKGKGNPEVEALRKEAAAIRDELQAYRHN | CD123 | 3.4 |
| 459 | MGSWIFFKQDLAEIKLNLEALGGSEAELAWFEDDIAWFESHLQDYKGKGNPEVEALRKEAAAIRDELQAYRHN | CD123 | 3.8 |
| 460 | MGSWHLFKWTLAEIKYELEALGGSEAELAWFEDDIATFEEELQWYKGKGNPEVEALRKEAAAIRDELQAYRHN | CD123 | 4 |

TABLE 1-continued

Exemplary target-specific binding DDs

| SEQ NO: | D-Domain Sequence | Target | ELISA_avg |
|---|---|---|---|
| 461 | MGSWVTFKDELADIKDFLEALGGSEAELAFFEVDIAEFEAE LQFYKGKGNPEVEALRKEAAAIRDELQAYRHN | CD123 | 7.6 |
| 462 | MGSWVYFKDELADIKDFLEALGGSEAELAEFEEDIATFEYD LQWYKGKGNPEVEALRKEAAAIRDELQAYRHN | CD123 | 4.6 |
| 463 | MGSWETFKYELAEIKDYLEALGGSEAELAWFEDDIAEFEFE LQYYKGKGNPEVEALRKEAAAIRDELQAYRHN | CD123 | 4.4 |
| 464 | MGSWNTFKYELAEIKHFLEALGGSEAELAMFEDDIAMFEWE LQEYKGKGNPEVEALRKEAAAIRDELQAYRHN | CD123 | 5 |
| 465 | MGSWYVFKDELAEIKQFLEALGGSEAELAWFEDDIAEFETQ LQHYKGKGNPEVEALRKEAAAIRDELQAYRHN | CD123 | 9.9 |
| 466 | MGSWIFFKEQLAIIKWELEALGGSEAELAWFEDDIAAFEDD LQFYKGQGNPEVEALRKEAAAIRDELQAYRHN | CD123 | 15 |
| 467 | MGSWEFFKEVLAEIKYDLEALGGSEAELAWFETDIAGFEID LQVYKGKGNPEVEALRKEAAAIRDELQAYRHN | CD123 | 8.2 |
| 468 | MGSWVFFKEDLATIKNDLEALGGSEAELAWFEMMIADFEAD LQYYKGKGNPEVEALRKEAAAIRDELQAYRHN | CD123 | 3.1 |
| 469 | MGSWEEFKEDLAEIKVWLEALGGSEAELAWFEMGIADFEDG LQFYKGKGNPEVEALRKEAAAIRDELQAYRHN | CD123 | 4.3 |
| 470 | MGSWHWFKEDLANIKDWLEALGGSEAELAWFEDNIADFEGD LQVYKGKGNPEVEALRKEAAAIRDELQAYRHN | CD123 | 3.3 |
| 471 | MGSWFWFKEDLAFIKEDLEALGGSEAELAWFEDGIAFFEWD LQDYKGKGNPEVEALRKEAAAIRDELQAYRHN | CD123 | 13.7 |
| 472 | MGSWQWFKEDLAEIKHDLEALGGSEAELAWFEDFIAQFEFD LQWYKGKGNPEVEALRKEAAAIRDELQAYRHN | CD123 | 3.8 |
| 473 | MGSWHWFKEDLAIIKQDLEALGGSEAELATFEQWIAEFEWD LQEYKGKGNPEVEALRKEAAAIRDELQAYRHN | CD123 | 5.5 |
| 474 | MGSWNWFKEDLAIIKMDLEALGGSEAELAWFEHNIAGFEFE LQGYKGKGNPEVEALRKEAAAIRDELQAYRHN | CD123 | 3.1 |
| 475 | MGSWSWFKEDLAEIKMELEALGGSEAELAYFEWYIAEFEFQ LQHYKGKGNPEVEALRKEAAAIRDELQAYRHN | CD123 | 4.8 |
| 476 | MGSWSWFKQDLADIKIQLEALGGSEAELAWFEWDIAEFEFE LQDYKGKGNPEVEALRKEAAAIRDELQAYRHN | CD123 | 4 |
| 477 | MGSWSWFKEDLADIKFELEALGGSEAELAWFELDIADFEQA LQQYKGKGNPEVEALRKEAAAIRDELQAYRHN | CD123 | 6.8 |
| 478 | MGSWSWFKEDLASIKAVLEALGGSEAELAFFESDIAEFEQE LQYYKGKGNPEVEALRKEAAAIRDELQAYRHN | CD123 | 6.9 |
| 479 | MGSWWEFKEDLAEIKWFLEALGGSEAELAWFEHDIAKFEFE LQYYKGKGNPEVEALRKEAAAIRDELQAYRHN | CD123 | 5.1 |
| 480 | MGSWEWFKSDLASIKWELEALGGSEAELAWFEHDIAEFEED LQWYKGKGNPEVEALRKEAAAIRDELQAYRHN | CD123 | 5.7 |
| 481 | MGSWNEFKDDLAMIKMTLEALGGSEAELAWFEHDIAEFEDD LQWYKGKGNPEVEALRKEAAAIRDELQAYRHN | CD123 | 3.5 |
| 482 | MGSWTFFKDDLAEIKWMLEALGGSEAELAWFESDIAYFEDE LQWYKGKGNPEVEALRKEAAAIRDELQAYRHN | CD123 | 3.3 |
| 483 | MGSWSDFKDDLAEIKMILEALGGSEAELAYFENDIAWFEDD LQEYKGKGNPEVEALRKEAAAIRDELQAYRHN | CD123 | 4.7 |
| 484 | MGSWSMFKDDLAEIKASLEALGGSEAELAWFEDDIAWFEDD LQHYKGKGNPEVEALRKEAAAIRDELQAYRHN | CD123 | 5.2 |
| 485 | MGSWQYFKDDLAEIKMVLEALGGSEAELAWFEADIAMFEDD LQIYKGKGNPEVEALRKEAAAIRDELQAYRHN | CD123 | 3.6 |

TABLE 1-continued

Exemplary target-specific binding DDs

| SEQ NO: | D-Domain Sequence | Target | ELISA_avg |
|---|---|---|---|
| 486 | MGSWSFFKDDLAEIKYFLEALGGSEAELAMFEQTIAEFEYDLQDYKGKGNPEVEALRKEAAAIRDELQAYRHN | CD123 | 10.1 |
| 487 | MGSWMEFKEELAEIKYILEALGGSEAELAWFEQSIADFEYDLQDYKGKGNPEVEALRKEAAAIRDELQAYRHN | CD123 | 5 |
| 488 | MGSWAWFKEDLAEIKVFLEALGGSEAELAEFEVSIADFEYELQDYKGKGNPEVEALRKEAAAIRDELQAYRHN | CD123 | 3.5 |
| 489 | MGSWYEFKFDLAEIKEQLEALGGSEAELALFEDDIAFFEYDLQNYKGKGNPEVEALRKEAAAIRDELQAYRHN | CD123 | 4.6 |
| 490 | MGSWYDFKYDLAEIKMDLEALGGSEAELAQFEFDIAFFEEELQDYKGKGNPEVEALRKEAAAIRDELQAYRHN | CD123 | 3.2 |
| 491 | MGSWYIFKEDLAEIKEELEALGGSEAELAYFEEEIALFEMELQWYKGKGNPEVEALRKEAAAIRDELQAYRHN | CD123 | 11.1 |
| 492 | MGSWVLFKEELAYIKFELEALGGSEAELALFENVIAIFESNLQNYKGKGNPEVEALRKEAAAIRDELQAYRHN | CD123 | 3.5 |
| 493 | MGSWQDFKEDLAWIKYELEALGGSEAELAFFEYDIAIFENNLQHYKGKGNPEVEALRKEAAAIRDELQAYRHN | CD123 | 3.2 |
| 494 | MGSWDHFKNDLAWIKKHLEALGGSEAELAEFEAVIAYFELYLQGYKGKGNPEVEALRKEAAAIRDELQAYRHN | CD123 | 3.3 |
| 495 | MGSWYDFKEDLADIKWMLEALGGSEAELAEFENVIAYFENDLQEYKGKGNPEVEALRKEAAAIRDELQAYRHN | CD123 | 8 |
| 496 | MGSWYMFKEELADIKWYLEALGGSEAELAWFEDDIAGFEWDLQAYKGKGNPEVEALRKEAAAIRDELQAYRHN | CD123 | 7 |
| 497 | MGSWYYFKDELADIKWDLEALGGSEAELAWFEMLIAQFELDLQWYKGKGNPEVEALRKEAAAIRDELQAYRHN | CD123 | 4 |
| 498 | MGSWMYFKDTLADIKWYLEALGGSEAELAFFEDWIAEFEDDLQVYKGKGNPEVEALRKEAAAIRDELQAYRHN | CD123 | 3.1 |
| 499 | MGSWYQFKHDLADIKYGLEALGGSEAELAWFEDDIADFELDLQYYKGKGNPEVEALRKEAAAIRDELQAYRHN | CD123 | 4.7 |
| 500 | MGSWYVFKDDLADIKYMLEALGGSEAELAWFEWEIANFEFDLQYYKGKGNPEVEALRKEAAAIRDELQAYRHN | CD123 | 3.8 |
| 501 | MGSWNFFKYDLADIMAYLEALGGSEAELAFFEDEIANFEHDLQKYKGKGNPEVEALRKEAAAIRDELQAYRHN | CD123 | 4.4 |
| 502 | MGSWHWFKIVLADIKDGLEALGGSEAELAYFETT IADFEMDLQHYKGKGNPEVEALRKEAAAIRDELQAYRHN | CD123 | 4.3 |
| 503 | MGSWHWFKIVLADIKDGLEALGGSEAELAYFETT IADFEMDLHHYKGKGNPEVEALRKEAAAIRDELQAYRHN | CD123 | 3.5 |
| 504 | MGSWFMFKEELADIKDWLEALGGSEAELASFESY IAWFEQDLQWYKGKGNPEVEALRKEAAAIRDELQAYRHN | CD123 | 5.7 |
| 505 | MGSWFMFKQELAWIKEDLEALGGSEAELADFEWDIAEFEWDLQYYKGKGNPEVEALRKEAAAIRDELQAYRHN | CD123 | 7.2 |
| 506 | MGSWQIFKGELAYIKQYLEALGGSEAELAFFEFDIAEFEEDLQYYKGKGNPEVEALRKEAAAIRDELQAYRHN | CD123 | 4.7 |
| 507 | MGSWDFFKEELAEIKHYLEALGGSEAELAFFEFWIADFEQDLQEYKGKGNPEVEALRKEAAAIRDELQAYRHN | CD123 | 3.7 |
| 508 | MGSWFNFKEELAVIKFQLEALGGSEAELAFFEWVIADFEDDLQEYKGKGNPEVEALRKEAAAIRDELQAYRHN | CD123 | 6.1 |
| 509 | MGSWYQFKTELAWIKDDLEALGGSEAELAWFEWVIADFEDDLQFYKGKGNPEVEALRKEAAAIRDELQAYRHN | CD123 | 6.6 |
| 510 | MGSWFEFKDYLADIKWDLEALGGSEAELAIFEHDIAYFEHNLQQYKGKGNPEVEALRKEAAAIRDELQAYRHN | CD123 | 3.8 |

TABLE 1-continued

Exemplary target-specific binding DDs

| SEQ NO: | D-Domain Sequence | Target | ELISA_avg |
|---|---|---|---|
| 511 | MGSWVRFKDFLADIKMDLEALGGSEAELADFEYHIAEFEHN LQEYKGKGNPEVEALRKEAAAIRDELQAYRHN | CD123 | 5.8 |
| 512 | MGSWWLFKEQLALIKYNLEALGGSEAELADFESWIAEFEHQ LQEYKGKGNPEVEALRKEAAAIRDELQAYRHN | CD123 | 4.1 |
| 513 | MGSWHVFKTELADIKFYLEALGGSEAELAMFELWIAEFEHE LQDYKGKGNPEVEALRKEAAAIRDELQAYRHN | CD123 | 5.4 |
| 514 | MGSWIWFKDWLADIKDLLEALGGSEAELAEFEYDIALFEDQ LQAYKGKGNPEVEALRKEAAAIRDELQAYRHN | CD123 | 7.3 |
| 515 | MGSWGWFKHELAFIKADLEALGGSEAELAWFEEEIAEFEYE LQFYKGKGNPEVEALRKEAAAIRDELQAYRHN | CD123 | 3.3 |
| 516 | MGSWTWFKDNLAWIKEDLEALGGSEAELAWFELEIASFETA LQDYKGKGNPEVEALRKEAAAIRDELQAYRHN | CD123 | 6.9 |
| 517 | MGSWTYFKNDLAGIKEDLEALGGSEAELAQFEFEIAEFEWL LQDYKGKGNPEVEALRKEAAAIRDELQAYRHN | CD123 | 3.6 |
| 518 | MGSWTWFKWDLADIKGDLEALGGSEAELAFFEEEIAEFEWR LQDYKGKGNPEVEALRKEAAAIRDELQAYRHN | CD123 | 5.9 |
| 519 | MGSWLYFKEYLADIKSDLEALGGSEAELAWFEYEIADFEEQ LQYYKGKGNPEVEALRKEAAAIRDELQAYRHN | CD123 | 3.7 |
| 520 | MGSWHWFKEELAEIKEDLVALGGSEAELAWFEYDIAMFELS LQNYKGKGNPEVEALRKEAAAIRDELQAYRHN | CD123 | 3.1 |
| 521 | MGSWNDFKEELAWIKFDLEALGGSEAELAWFEEDIAMFEQQ LQAYKGKGNPEVEALRKEAAAIRDELQAYRHN | CD123 | 3.8 |
| 522 | MGSWWDFKDWLAEIKHDLEALGGSEAELALFESEIADFEFG LQWYKGKGNPEVEALRKEAAAIRDELQAYRHN | CD123 | 4.2 |
| 523 | MGSWDEFKEDLAHIKTDLEALGGSEAELALFEDEIADFEMY LQHYKGKGNPEVEALRKEAAAIRDELQAYRHN | CD123 | 6.3 |
| 524 | MGSWDFFKYDLANINEWLEALGGSEAELADFEYGIADFELW LQDYKGKGNPEVEALRKEAAAIRDELQAYRHN | CD123 | 5.5 |
| 525 | MGSWYQFKDDLAHIKHLLEALGGSEAELAVFEYIIADFESF LQIYKGKGNPEVEALRKEAAAIRDELQAYRHN | CD123 | 4 |
| 526 | MGSWAEFKHDLADIKRELEALGGSEAELAWFELSIAFFEDE LQHYKGKGNPEVEALRKEAAAIRDELQAYRHN | CD123 | 3.3 |
| 527 | MGSWVVFKQDLADINHQLEALGGSEAELAWFEWEIADFEWE LQHYKGKGNPEVEALRKEAAAIRDELQAYRHN | CD123 | 3.6 |
| 528 | MGSWFQFKEFLAMITHNLEALGGSEAELAEFEHDIALFESE LQQYKGKGNPEVEALRKEAAAIRDELQAYRHN | CD123 | 3.1 |
| 529 | MGSWHWFKEDLAMITDVLEALGGSEAELAAFESEIAVFEAD LQYYKGKGNPEVEALRKEAAAIRDELQAYRHN | CD123 | 5.2 |
| 530 | MGSWSWFQWDLAGIKDHLEALGGSEAELAEFESEIAYFEDE LQWYKGKGNPEVEALRKEAAAIRDELQAYRHN | CD123 | 12.9 |
| 531 | MGSWTEFKGELAEIKWILEALGGSEAELAFFEDEIAAFEWD LQKYKGKGNPEVEALRKEAAAIRDELQAYRHN | CD123 | 8.2 |
| 532 | MGSWFEFKWTLALIKQELEALGGSEAELADFEQEIAEFEWW LQTYKGKGNPEVEALRKEAAAIRDELQAYRHN | CD123 | 4.9 |
| 533 | MGSWAEFKQRLAAIKTRLEALGGSEAELAAFMDEIMAFEWE LWAYKGKGNPEVEALMNEAFAIDVELYAYRHN | CD123 | 3.4 |
| 534 | MGSWAEFKQRLAAIKTRLEALGGSEAELAAFEWEIVAFFSE LFAYKGKGNPEVEALRDEAIAIETELVAYRHN | CD123 | 3.6 |
| 535 | MGSWWEFDHRLTAIDTRLQALGGSEAELAEFESSIAEFEWW LQDYKGKGNPEVEALFAEAEAIYVELDAYRHN | CD123 | 4.3 |

TABLE 1-continued

Exemplary target-specific binding DDs

| SEQ NO: | D-Domain Sequence | Target | ELISA_avg |
|---|---|---|---|
| 536 | MGSWWEFQFRLYAIDQRLLALGGSEAELAEFEQDIADFEWM LQDYKGKGNPEVEALMLEADAIEAELKAYRHN | CD123 | 3.1 |
| 537 | MGSWYEFDHRLDAIYQRLWALGGSEAELAEFEYGIAEFEEY LQDYKGKGNPEVEALISEAWAIEWELSAYRHN | CD123 | 4.6 |
| 538 | MGSWYEFDMRLDAIWERLTALGGSEAELADFEQYIAEFERQ LQDYKGKGNPEVEALFDEAWAIEDELYAYRHN | CD123 | 13.7 |
| 539 | MGSWSEFDSRLDAIAYRLFALGGSEAELAQFEWIIADFEED LQMYKGKGNPEVEALFSEAYAIEIELNAYRHN | CD123 | 4.3 |
| 540 | MGSWYEFDDRLDAIAYRLNALGGSEAELAWFEWEIAEFELD LQWYKGKGNPEVEALVWEADAIEWELEAYRHN | CD123 | 4.6 |
| 541 | MGSWFEFDERLDAIGSRLTALGGSEAELASFEFYIADFEEW LQQYKGKGNPEVEALEWEAFAIDEELGAYRHN | CD123 | 3.8 |
| 542 | MGSWEEFDQRLDAIDVRLYALGGSEAELAEFEFDIAAFEEW LQLYKGKGNPEVEALNMEAFAITDELCAYRHN | CD123 | 3.6 |
| 543 | MGSWEEFDVRLDAIFNRLWALGGSEAELAEFEFDIAWFEMD LQEYKGKGNPEVEALFDEAEAITNELVAYRHN | CD123 | 4.7 |
| 544 | MGSWEEFDKRLDAITRRLMALGGSEAELAEFESTIAWFEWD LQEYKGKGNPEVEALDWEAYAIDYELGAYRHN | CD123 | 4.5 |
| 545 | MGSWYEFDHRLEAIYDRLWALGGSEAELAFFEFDIADFEWD LQSYKGKGNPEVEALFDEAAAIGHELLAYRHN | CD123 | 4.5 |
| 546 | MGSWNEFDDRLLAIWGRLDALGGSEAELAFFEEQIAGFEDE LQWYKGKGNPEVEALDQEAEAIEKELWAYRHN | CD123 | 4.1 |
| 547 | MGSWVEFDDRLDAIWERLDALGGSEAELAWFEEQIAVFEHQ LQDYKGKGNPEVEALNQEAEAIDLELKAYRHN | CD123 | 5 |
| 548 | MGSWTEFDDRLFAIYWRLDALGGSEAELAWFEEVIAEFEND LQVYKGKGNPEVEALDDEAHAISIELEAYRHN | CD123 | 6.4 |
| 549 | MGSWSEFDQRLEAIWNRLDALGGSEAELADFEREIAYFENQ LQWYKGKGNPEVEALNNEAFAIVDELGAYRHN | CD123 | 3.4 |
| 550 | MGSWYEFDERLWAIWERLDALGGSEAELAHFEWVIADFEND LQWYKGKGNPEVEALEFEAEAIVTELHAYRHN | CD123 | 3.6 |
| 551 | MGSWMEFDYRLEAIWMRLIALGGSEAELADFESSIADFEHH LQSYKGKGNPEVEALEWEAFAIGVELDAYRHN | CD123 | 3.1 |
| 552 | MGSWYEFESRLEAIWWRLEALGGSEAELAQFEQYIADFEQH LQWYKGKGNPEVEALDWEADAIWLELQAYRHN | CD123 | 4.4 |
| 553 | MGSWEEFYMRLVAIHMRLRALGGSEAELAVFENYIAEFEEY LQYYKGKGNPEVEALTIEADAIGTELGAYRHN | CD123 | 4.4 |
| 554 | MGSWDEFYYRLVAITHRLHALGGSEAELAWFEDDIAGFEWD LQTYKGKGNPEVEALYKEAGAIGMELTAYRHN | CD123 | 5.4 |
| 555 | MGSWEEFDTRLLAIFGRLGALGGSEAELALFEMLIAKFEDD LQNYKGKGNPEVEALSEEAFAIDHELGAYRHN | CD123 | 6.7 |
| 556 | MGSWREFDQRLWAIDWRLEALGGSEAELAMFEWMIATFEDD LQWYKGKGNPEVEALYREAFAIDWELDAYRHN | CD123 | 3.4 |
| 557 | MGSWEEFHERLDAIDERLEALGGSEAELAFFEDDIASFEDW LQWYKGKGNPEVEALSREADAINFELEAYRHN | CD123 | 4.3 |
| 558 | MGSWNEFYERLEAIDRRLFALGGSEAELALFEWMIADFEDD LQMYKGKGNPEVEALINEAGAIGFELEAYRHN | CD123 | 5.2 |
| 559 | MGSWTEFTQRLEAIVDRLFALGGSEAELAEFENSIADFEWD LQWYKGKGNPEVEALNREAVAIDNELWAYRHN | CD123 | 3.9 |
| 560 | MGSWVEFIMRLDAIYERLDALGGSEAELAEFEWHIADFEDH LQWYKGKGNPEVEALFEEADAIWEELWAYRHN | CD123 | 6.4 |

TABLE 1-continued

Exemplary target-specific binding DDs

| SEQ NO: | D-Domain Sequence | Target | ELISA_avg |
|---|---|---|---|
| 561 | MGSWNEFLLRLDAIEHRLFALGGSEAELAEFEWEIADFEDD LQWYKGKGNPEVEALVEEAEAIDVELVAYRHN | CD123 | 3.2 |
| 562 | MGSWYEFNMRLGAIDDRLQALGGSEAELAWFEDMIAIFEDD LQIYKGKGNPEVEALEQEAAAIHQELWAYRHN | CD123 | 3.8 |
| 563 | MGSWEEFHWRLGAIDARLEALGGSEAELAWFEDGIADFEAI LQDYKGKGNPEVEALDSEAVAIHHELWAYRHN | CD123 | 3.3 |
| 564 | MGSWYEFYERLWAIDDRLWALGGSEAELAEFEDSIATFEPS LQMYKGKGNPEVEALVAEAWAIFDELAAYRHN | CD123 | 3.6 |
| 565 | MGSWFEFDQRLDAITFRLWALGGSEAELAEFEDVIALFEYH LQDYKGKGNPEVEALEVEAWAIFHELGAYRHN | CD123 | 3.2 |
| 566 | MGSWSEFWFRLDAIEDRLWALGGSEAELAEFEDNIALFEYS LQHYKGKGNPEVEALVKEANAIDDELGAYRHN | CD123 | 4.5 |
| 567 | MGSWYEFWDRLTAIEHRLWALGGSEAELAYFEDSIAHFEGS LQVYKGKGNPEVEALYKEAEAIEWELEAYRHN | CD123 | 4.4 |
| 568 | MGSWYEFDDRLWAIFDRLFALGGSEAELAFFEDSIAEFEEE LQHYKGKGNPEVEALYLEAWAIENELGAYRHN | CD123 | 4.7 |
| 569 | MGSWNEFVERLSAIDHRLWALGGSEAELADFEQQIAEFEIH LQEYKGKGNPEVEALDFEADAIFDELLAYRHN | CD123 | 3.2 |
| 570 | MGSWSEFVDRLDAIFDRLWALGGSEAELAWFEDTIAHFEWN LQEYKGKGNPEVEALNGEADAITDELHAYRHN | CD123 | 5.3 |
| 571 | MGSWAEFDSRLDAIAQRLFALGGSEAELAHFEDFIAQFEYS LQEYKGKGNPEVEALSNEADAIFNELKAYRHN | CD123 | 3.6 |
| 572 | MGSWAEFDSRLIAIFDRLWALGGSEAELAWFEDDIAQFEQH LQAYKGKGNPEVEALRQEADAITFELKAYRHN | CD123 | 3.6 |
| 573 | MGSWTEFEERLEAIWDRLYALGGSEAELAAFEWDIAYFEDG LQEYKGKGNPEVEALFMEAEAIIRELKAYRHN | CD123 | 5.9 |
| 574 | MGSWYEFEDRLAAIWDRLNALGGSEAELAIFEWDIAWFEEG LQEYKGKGNPEVEALKHEASAIQTELFAYRHN | CD123 | 6.4 |
| 575 | MGSWLEFESRLWAIWDRLDALGGSEAELAHFEQDIADFEMS LQEYKGKGNPEVEALIREAEAIETELYAYRHN | CD123 | 3.4 |
| 576 | MGSWMEFEDRLIAIWARLDALGGSEAELAWFEADIADFEES LQEYKGKGNPEVEALIFEAIAINKELMAYRHN | CD123 | 3.7 |
| 577 | MGSWFEFTIRLEAIQDRLDALGGSEAELAWFEWDIAEFEEG LQFYKGKGNPEVEALHTEADAIMNELVAYRHN | CD123 | 3.5 |
| 578 | MGSWYEFVSRLDAIEYRLWALGGSEAELAWFEWDIADFEQG LQFYKGKGNPEVEALAQEANAIGSELTAYRHN | CD123 | 3.2 |
| 579 | MGSWEEFDYRLYAIQDRLYALGGSEAELAFFEWEIADFEHM LQMYKGKGNPEVEALFQEADAIDAELHAYRHN | CD123 | 4.4 |
| 580 | MGSWIEFFHRLDAIQDRLDALGGSEAELAYFEWAIADFEHM LQLYKGKGNPEVEALQFEAFAIEGELYAYRHN | CD123 | 3.5 |
| 581 | MGSWYEFSSRLNAIDDRLWALGGSEAELAYFETDIADFESL LQWYKGKGNPEVEALLNEADAIDYELYAYRHN | CD123 | 3.8 |
| 582 | MGSWFEFEYRLDAIIDRLFALGGSEAELAEFESMIANFEYS LQEYKGKGNPEVEALYFEADAIVDELTAYRHN | CD123 | 4 |
| 583 | MGSWLEFEYRLDAIYDRLFALGGSEAELAAFEQDIADFEKY LQYYKGKGNPEVEALWEEADAIMWELFAYRHN | CD123 | 3.1 |
| 584 | MGSWHEFEERLMAIEDRLWALGGSEAELAEFEQWIALFEYD LQEYKGKGNPEVEALGMEAFAINNELSAYRHN | CD123 | 5.8 |
| 585 | MGSWYEFEERLDAIEDRLIALGGSEAELAIFEDIIAFFEQD LQYYKGKGNPEVEALEMEAEAISIELDAYRHN | CD123 | 4.1 |

TABLE 1-continued

Exemplary target-specific binding DDs

| SEQ NO: | D-Domain Sequence | Target | ELISA_avg |
|---|---|---|---|
| 586 | MGSWHEFEKRLYAIEDRLIALGGSEAELAWFEDSIAWFEWDLQMYKGKGNPEVEALNEEADAIYQELDAYRHN | CD123 | 3.6 |
| 587 | MGSWIEFEDRLDAITDRLWALGGSEAELAEFEHQIAFFEEDLQWYKGKGNPEVEALHMEAEAIMEELGAYRHN | CD123 | 9.5 |
| 588 | MGSWMEFEDRLMAIVDRLWALGGSEAELADFEWNIAMFEEELQWYKGKGNPEVEALGDEAEAIEWELYAYRHN | CD123 | 6.8 |
| 589 | MGSWEEFEDRLFAIDSRLWALGGSEAELAEFENIIASFEEVLQEYKGKGNPEVEALSVEAFAIDRELGAYRHN | CD123 | 3.7 |
| 590 | MGSWEEFLFRLEAIQDRLWALGGSEAELAWFEYEIASFEDVLQSYKGKGNPEVEALSTEAKAIDYELFAYRHN | CD123 | 8.2 |
| 591 | MGSWVEFDNRLFAIDERLWALGGSEAELAWFEEEIASFEDNLQKYKGKGNPEVEALQLEAFAIMEELDAYRHN | CD123 | 3.3 |
| 592 | MGSWFEFDDRLEAIFDRLWALGGSEAELAMFEFAIAEFEDALQEYKGKGNPEVEALYEEAVAIDEELYAYRHN | CD123 | 4.1 |
| 593 | MGSWFEFDARLMAINDRLWALGGSEAELAAFEYHIALFEDQLQMYKGKGNPEVEALTLEAVAINEELWAYRHN | CD123 | 4 |
| 594 | MGSWVEFDSRLAAIDYRLEALGGSEAELAWFEYTIANFEHTLQMYKGKGNPEVEALVYEAHAIATELQAYRHN | CD123 | 3.4 |
| 595 | MGSWTEFDERLDAIDWRLEALGGSEAELAWFEGDIALFEQYLQVYKGKGNPEVEALMEEADAIKAELDAYRHN | CD123 | 4.5 |
| 596 | MGSWIEFDERLDAIDFRLWALGGSEAELAWFEGWIAEFESDLQLYKGKGNPEVEALNEEANAIFHELSAYRHN | CD123 | 7 |
| 597 | MGSWWEFDSRLDAIDFRLWALGGSEAELAWFEVEIADFEDWLQLYKGKGNPEVEALWHEADAIVTELYAYRHN | CD123 | 3.2 |
| 598 | MGSWYEFDERLDAIFDRLWALGGSEAELAYFEQVIATFEKTLQRYKGKGNPEVEALDTEAKAISWELDAYRHN | CD123 | 3 |
| 599 | MGSWYEFQERLDAIDSRLWALGGSEAELAWFEYTIAEFEKELQMYKGKGNPEVEALGTEAVAISEELMAYRHN | CD123 | 5.5 |
| 600 | MGSWEEFEDRLWAIDGRLYALGGSEAELAWFEQWIATFEEDLQDYKGKGNPEVEALEYEASAIFEELEAYRHN | CD123 | 9.4 |
| 601 | MGSWFEFGDRLEAIDERLYALGGSEAELAQFEWWIAEFEHHLQDYKGKGNPEVEALEYEADAIWGELHAYRHN | CD123 | 4.5 |
| 602 | MGSWFEFNDRLDAISERLSALGGSEAELAYFEWQIAVFEKTLQNYKGKGNPEVEALTLEANAIFEELEAYRHN | CD123 | 3.9 |
| 603 | MGSWVEFMDRLEAIEERLSALGGSEAELAFFEWEIAEFEEHLQVYKGKGNPEVEALEWEALAITEELAAYRHN | CD123 | 4 |
| 604 | MGSWIEFMDRLWAIDQRLWALGGSEAELAWFEEEIAWFEEELQVYKGKGNPEVEALEWEATAISEELWAYRHN | CD123 | 6.5 |
| 605 | MGSWEEFNWRLRAIDERLFALGGSEAELAWFEYDIAEFEEQLQVYKGKGNPEVEALRVEAAAIAEELYAYRHN | CD123 | 5.4 |
| 606 | MGSWWEFEIRLDAIDERLWALGGSEAELAWFEQSIAFFENDLQVYKGKGNPEVEALRWEANAIIEELFAYRHN | CD123 | 3.2 |
| 607 | MGSWYEFEWRLDAIDRRLWALGGSEAELADFEEEIADFEWMLQNYKGKGNPEVALVDEASAIQTELWAYRHN | CD123 | 10 |
| 608 | MGSWYEFVYRLRAIDERLDALGGSEAELAMFEFEIAFFEDQLQRYKGKGNPEVEALVDEAQAIDFELFAYRHN | CD123 | 4.5 |
| 609 | MGSWWEFEDRLYAIDDRLWALGGSEAELAQFEREIAQFEIWLQEYKGKGNPEVEALDDEATAINSELFAYRHN | CD123 | 5.5 |
| 610 | MGSWDEFEFRLEAIDSRLWALGGSEAELAVFEYEIAQFEFMLQEYKGKGNPEVEALGMEAWAIENELFAYRHN | CD123 | 3.6 |

TABLE 1-continued

Exemplary target-specific binding DDs

| SEQ NO: | D-Domain Sequence | Target | ELISA_avg |
|---|---|---|---|
| 611 | MGSWEEFEWRLDAIDERLWALGGSEAELATFEYEIAIFENE LQQYKGKGNPEVEALDSEAYAIERELGAYRHN | CD123 | 4.3 |
| 612 | MGSWYEFFDRLDAIDERLWALGGSEAELAWFEAEIAEFEME LQGYKGKGNPEVEALDVEAHAIEMELFAYRHN | CD123 | 3.7 |
| 613 | MGSWYEFMGRLEAIDERLQALGGSEAELAWFEHEIAEFEWS LQWYKGKGNPEVEALRFEAGAIPWELWAYRHN | CD123 | 3.5 |
| 614 | MGSWVEFSNRLDAIWERLQALGGSEAELAYFEWEIAEFEWE LQSYKGKGNPEVEALNAEADAIEWELEAYRHN | CD123 | 5.1 |
| 615 | MGSWEEFHMRLIAIDERLWALGGSEAELAGFEESIAYFESQ LQDYKGKGNPEVEALDYEAHAIWRELYAYRHN | CD123 | 3.9 |
| 616 | MGSWWEFKYRLDAICFRLAALGGSEAELASFEDEIAYFEED LQGYKGKGNPEVEALDYEALAIWDELAAYRHN | CD123 | 3.1 |
| 617 | MGSWDEFAMRLEAIQARLFALGGSEAELAIFEDEIAFFETM LQDYKGKGNPEVEALEYEAAAIEAELGAYRHN | CD123 | 3.7 |
| 618 | MGSWWEFNARLDAIEDRLMALGGSEAELAYFEDIIASFENI LQQYKGKGNPEVEALWYEAYAIEKELNAYRHN | CD123 | 3.4 |
| 619 | MGSWIEFWNRLEAIEERLYALGGSEAELAYFEDEIAEFEIY LQQYKGKGNPEVEALKHEAEAINKELMAYRHN | CD123 | 5.2 |
| 620 | MGSWNEFVIRLFAIDDRLYALGGSEAELAWFEDEIATFEYE LQRYKGKGNPEVEALEYEAEAIVSELFAYRHN | CD123 | 3.5 |
| 621 | MGSWYEFLARLYAIDERLWALGGSEAELATFEHWIADFEEQ LQSYKGKGNPEVEALTDEAVAIGEELSAYRHN | CD123 | 4.5 |
| 622 | MGSWLEFETRLHAIDERLWALGGSEAELAEFEEHIAWFEED LQFYKGKGNPEVEALDFEADAIGWELWAYRHN | CD123 | 4.6 |
| 623 | MGSWFEFETRLEAIDLRLWALGGSEAELATFEDVIAFFEDW LQFYKGKGNPEVEALKMEAWAIGEELHAYRHN | CD123 | 6.6 |
| 624 | MGSWHEFWQRLEAIEGRLWALGGSEAELADFESLIADFEEQ LQEYKGKGNPEVEALMAEAEAIDNELRAYRHN | CD123 | 7 |
| 625 | MGSWYEFEQRLEAIEWRLGALGGSEAELATFEEDIADFEEW LQEYKGKGNPEVEALQYEAYAIAEELHAYRHN | CD123 | 4.4 |
| 626 | MGSWYEFENRLFAIEERLWALGGSEAELAWFEYEIANFEWG LQSYKGKGNPEVEALDNEAEAIDIELAAYRHN | CD123 | 3.3 |
| 627 | MGSWYEFEQRLGAIEERLWALGGSEAELAAFEDIIAYFEYQ LQSYKGKGNPEVEALDEEAWAIDDELWAYRHN | CD123 | 10.6 |
| 628 | MGSWWEFEQRLDAIETRLWALGGSEAELAYFEHIIADFEDE LQIYKGKGNPEVEALGWEAFAIDGELTAYRHN | CD123 | 4.7 |
| 629 | MGSWFEFPYRLEAIEERLYALGGSEAELAQFEQFIAWFEMD LQDYKGKGNPEVEALWFEANAIVEELDAYRHN | CD123 | 3.1 |
| 630 | MGSWVEFYDRLEAIEIRLWALGGSEAELADFESFIAHFEDD LQAYKGKGNPEVEALMDEANAIVFELDAYRHN | CD123 | 4 |
| 631 | MGSWVEFWDRLDAIEERLWALGGSEAELAEFEFMIAMFEQH LQEYKGKGNPEVEALIPEAGAIDKELTAYRHN | CD123 | 10 |
| 632 | MGSWDEFDARLWAIEERLWALGGSEAELAEFEFMIAAFEDV LQEYKGKGNPEVEALMGEANAIVMELDAYRHN | CD123 | 4.3 |
| 633 | MGSWYEFWRRLDAIEERLWALGGSEAELAMFETDIAGFEWM LQLYKGKGNPEVEALEHEAWAINSELDAYRHN | CD123 | 3.6 |
| 634 | MGSWHEFIWRLDAIEERLWALGGSEAELAWFETEIATFEAQ LQDYKGKGNPEVEALEWEAIAIAWELDAYRHN | CD123 | 3.3 |
| 635 | MGSWYEFYWRLEAIEERLWALGGSEAELAEFEKAIATFEDQ LQTYKGKGNPEVEALETEALAIHAELEAYRHN | CD123 | 3.7 |

TABLE 1-continued

Exemplary target-specific binding DDs

| SEQ NO: | D-Domain Sequence | Target | ELISA_avg |
|---|---|---|---|
| 636 | MGSWFEFQWRLEAIEDRLWALGGSEAELAEFETIIAGFEEQLQVYKGKGNPEVEALEEEAMAIQTELHAYRHN | CD123 | 3.4 |
| 637 | MGSWWEFEDRLWAIEQRLDALGGSEAELAVFENSIAKFEDMLQVYKGKGNPEVEALHEEADAIIWELYAYRHN | CD123 | 4.4 |
| 638 | MGSWWEFEDRLWAIDRRLMALGGSEAELAVFEQMIAHFEQILQVYKGKGNPEVEALHFEAHAIGMELAAYRHN | CD123 | 4.6 |
| 639 | MGSWWEFLDRLEAIEYRLQALGGSEAELAVFEWEIAMFEDHLQGYKGKGNPEVEALHSEAHAIISELSAYRHN | CD123 | 3.1 |
| 640 | MGSWAEFEDRLAAIERRLEALGGSEAELADFESSIAWFEPDLQYYKGKGNPEVEALMYEAEAIFSELYAYRHN | CD123 | 4.2 |
| 641 | MGSWWEFYDRLTAIEARLWALGGSEAELADFEEGIADFEYDLQDYKGKGNPEVEALFWEAWAIQSELTAYRHN | CD123 | 3.2 |
| 642 | MGSWYEFEDRLAAIEARLWALGGSEAELADFEEEIAYFEHGLQWYKGKGNPEVEALESEAMAIIDELHAYRHN | CD123 | 3.8 |
| 643 | MGSWWEFSWRLEAIETRLDALGGSEAELAFFEMDIAWFEQDLQLYKGKGNPEVEALEEEAYAIYEELEAYRHN | CD123 | 3.3 |
| 644 | MGSWEEFFFRLEAIDDRLYALGGSEAELALFEEVIAYFEQDLQWYKGKGNPEVEALYVEAYAIQEELYAYRHN | CD123 | 3.2 |
| 645 | MGSWFEFEERLNAISWRLHALGGSEAELAYFEEDIAWFEDDLQFYKGKGNPEVEALENEAYAIWEELDAYRHN | CD123 | 13 |
| 646 | MGSWFEFEERLEAIIYRLWALGGSEAELAMFEESIAWFESDLQQYKGKGNPEVEALEYEAMAISKELKAYRHN | CD123 | 3.7 |
| 647 | MGSWAEFDDRLEAIEYRLHALGGSEAELAWFEEGIAGFEHALQSYKGKGNPEVEALETEAGAINEELWAYRHN | CD123 | 5.8 |
| 648 | MGSWDEFEERLQAIEYRLWALGGSEAELAWFEEVIAQFEYDLQKYKGKGNPEVEALSTEAQAIQDELWAYRHN | CD123 | 3.8 |
| 649 | MGSWWEFTDRLDAIFDRLWALGGSEAELAAFEESIAIFEQDLQYYKGKGNPEVEALEYEANAIQYELEAYRHN | CD123 | 7.5 |
| 650 | MGSWWEFTDRLEAIEDRLWALGGSEAELAHFEDSIAQFEQELQWYKGKGNPEVEALADEADAIESELHAYRHN | CD123 | 16.6 |
| 651 | MGSWVEFFWRLDAIEDRLWALGGSEAELANFEFEIADFEAWLQKYKGKGNPEVEALHSEADAIQLELRAYRHN | CD123 | 4 |
| 652 | MGSWVEFYNRLDAIENRLWALGGSEAELAFFEELIAQFEFALQDYKGKGNPEVEALEDEADAIWEELMAYRHN | CD123 | 6.9 |
| 653 | MGSWEEFYYRLHAIDNRLWALGGSEAELAYFEWHIADFELELQDYKGKGNPEVEALSEEATAIFEELWAYRHN | CD123 | 3 |
| 654 | MGSWREFHDRLFAIDGRLWALGGSEAELANFEWDIADFEFELQDYKGKGNPEVEALSWEADAIMQELGAYRHN | CD123 | 5.6 |
| 655 | MGSWEEFDERLWAISDRLWALGGSEAELAYFEGEIAYFEQNLQTYKGKGNPEVEALQTEALAIDTELWAYRHN | CD123 | 6.5 |
| 656 | MGSWEEFEQRLWAIDDRLWALGGSEAELAFFEYEIAEFEMDLQWYKGKGNPEVEALFYEAHAINEELWAYRHN | CD123 | 5.7 |
| 657 | MGSWDEFHQRLAAIGDRLWALGGSEAELAYFEWEIATFEWDLQVYKGKGNPEVEALYFEATAIDEELMAYRHN | CD123 | 3.7 |
| 658 | MGSWVEFEYRLDAISDRLWALGGSEAELAFFENEIASFESDLQFYKGKGNPEVEALMFEAEAIDDELHAYRHN | CD123 | 6.5 |
| 659 | MGSWDEFDTRLDAIFSRLYALGGSEAELAMFEGEIAEFEGSLQHYKGKGNPEVEALDFEAHAIDEELWAYRHN | CD123 | 4 |
| 660 | MGSWHEFDDRLDAIMSRLDALGGSEAELATFEAEIATFEFVLQLYKGKGNPEVEALLAEAYAIDWELEAYRHN | CD123 | 7.7 |

TABLE 1-continued

Exemplary target-specific binding DDs

| SEQ NO: | D-Domain Sequence | Target | ELISA_avg |
|---|---|---|---|
| 661 | MGSWYEFFDRLDAIYDRLYALGGSEAELASFEAQIAEFEVE LQSYKGKGNPEVEALEWEAWAIDEELYAYRHN | CD123 | 4.7 |
| 662 | MGSWFEFLYRLDAIEDRLWALGGSEAELAEFEQEIAKFESE LQSYKGKGNPEVEALEWEAHAIDMELEAYRHN | CD123 | 6.6 |
| 663 | MGSWLEFEDRLVAIDHRLFALGGSEAELAEFEEEIALFESY LQDYKGKGNPEVEALNWEADAIHAELYAYRHN | CD123 | 3.9 |
| 664 | MGSWYEFESRLDAIVDRLWALGGSEAELAEFEYEIAKFEWE LQDYKGKGNPEVEALNWEAGAIEFELYAYRHN | CD123 | 5.1 |
| 665 | MGSWYEFEDRLDAILYRLLALGGSEAELAWFERDIAFFESE LQWYKGKGNPEVEALEWEAMAIDDELFAYRHN | CD123 | 4.3 |
| 666 | MGSWGEFMDRLEAIDYRLWALGGSEAELAWFESDIAEFEQE LQMYKGKGNPEVEALWDEAMAIRDELFAYRHN | CD123 | 4.6 |
| 667 | MGSWEEFDDRLDAIEHRLWALGGSEAELADFEGSIAAFESW LQVYKGKGNPEVEALEAEAEAIADELWAYRHN | CD123 | 4 |
| 668 | MGSWYEFADRLDAIMDRLVALGGSEAELAYFEWEIAAFEEF LQMYKGKGNPEVEALDEEAEAIKDELMAYRHN | CD123 | 3.3 |
| 669 | MGSWNEFWERLDAIEWRLFALGGSEAELAFFELDIAWFEEE LQWYKGKGNPEVEALIFEAHAITLELDAYRHN | CD123 | 3 |
| 670 | MGSWYEFDARLDAIEERLYALGGSEAELAAFEFEIAGFEEA LQWYKGKGNPEVEALLKEAEAITDELYAYRHN | CD123 | 8.9 |
| 671 | MGSWDEFSERLDAIWGRLEALGGSEAELATFEFHIAEFEHE LQYYKGKGNPEVEALQGEAAAIINELYAYRHN | CD123 | 3.2 |
| 672 | MGSWDEFWDRLDAIEDRLFALGGSEAELADFERVIAWFEND LQEYKGKGNPEVEALDNEADAIRIELHAYRHN | CD123 | 3.9 |
| 673 | MGSWDEFDDRLEAIVDRLFALGGSEAELAMFEFEIAQFEHQ LQYYKGKGNPEVEALRDEADAIWIELDAYRHN | CD123 | 5.6 |
| 674 | MGSWEEFTIRLGAIYWRLFALGGSEAELANFEWFIAEFEYE LQPYKGKGNPEVEALVIEANAIDGELQAYRHN | CD123 | 3.3 |
| 675 | MGSWFEFEWRLDAIENRLNALGGSEAELAWFEYHIAAFEDS LQHYKGKGNPEVEALEWEAHAIQSELQAYRHN | CD123 | 3.3 |
| 676 | MGSWYEFDDRLEAIWDRLGALGGSEAELAAFEKEIAAFESE LQAYKGKGNPEVEWLRETAADIRAELQAYRHN | CD123 | 3.3 |
| 677 | MGSWGEFWARLEAIWIRLDALGGSEAELAAFEKEIAAFESE LQAYKGKGNPEVEWLREEAADIRRSLQAYRHN | CD123 | 15 |
| 678 | MGSWIEFEVRLDAIWDRLFALGGSEAELAAFEKEIAAFESE LQAYKGKGNPEVEYLRDEAADIRQSLQAYRHN | CD123 | 4.2 |
| 679 | MGSWTEFDRRLDAIWDRLFALGGSEAELAAFEKEIAAFESE LQAYKGKGNPEVEWLREEAADIRDYLQAYRHN | CD123 | 9.2 |
| 680 | MGSWTEFDMRLDAIWDRLFALGGSEAELAAFEKEIAAFESE LQAYKGKGNPEVEELREEAATIRGVLQAYRHN | CD123 | 3.1 |
| 681 | MGSWEEFHDRLMAIETRLWALGGSEAELAAFEKEIAAFESE LQAYKGKGNPEVEWLRYEAADIRDYLQAYRHN | CD123 | 4.3 |
| 682 | MGSWVEFRDRLDAIETRLWALGGSEAELAAFEKEIAAFESE LQAYKGKGNPEVEWLRYEAAEIRMVLQAYRHN | CD123 | 4.2 |
| 683 | MGSWMEFIDRLDAIEHRLWALGGSEAELAAFEKEIAAFESE LQAYKGKGNPEVEFLREEAAEIRMYLQAYRHN | CD123 | 4.3 |
| 684 | MGSWTEFVWRLDAIEWRLEALGGSEAELAAFEKEIAAFESE LQAYKGKGNPEVEFLREEAAEIRDWLQAYRHN | CD123 | 4.2 |
| 685 | MGSWVEFYDRLYAIEVRLLALGGSEAELAAFEKEIAAFESE LQAYKGKGNPEVEFLRQEAAEIRDWLQAYRHN | CD123 | 5.8 |

TABLE 1-continued

Exemplary target-specific binding DDs

| SEQ NO: | D-Domain Sequence | Target | ELISA_avg |
|---|---|---|---|
| 686 | MGSWYEFYDRLDAIEWRLWALGGSEAELAAFEKEIAAFESE LQAYKGKGNPEVEWLRDEAAQIRDFLQAYRHN | CD123 | 6.2 |
| 687 | MGSWVEFYDRLDAIEHRLDALGGSEAELAAFEKEIAAFESE LQAYKGKGNPEVEWLRDEAAFIRDMLQAYRHN | CD123 | 3.4 |
| 688 | MGSWFEFVDRLTAIQVRLWALGGSEAELAAFEKEIAAFESE LQAYKGKGNPEVEYLREEAALIRYSLQAYRHN | CD123 | 5.1 |
| 689 | MGSWFEFLDRLDAIEERLWALGGSEAELAAFEKEIAAFESE LQAYKGKGNPEVEWLREEAAVIRDSLQAYRHN | CD123 | 12.2 |
| 690 | MGSWYEFMVRLDAIEERLFALGGSEAELAAFEKEIAAFESE LQAYKGKGNPEVEFLREEAASIRYHLQAYRHN | CD123 | 4.1 |
| 691 | MGSWYEFEDRLDAIQWRLWALGGSEAELAAFEKEIAAFESE LQAYKGKGNPEVEFLRESAANIRQHLQAYRHN | CD123 | 6.3 |
| 692 | MGSWSEFEYRLFAIENRLDALGGSEAELAAFEKEIAAFESE LQAYKGKGNPEVEFLREEAAMIRQLLQAYRHN | CD123 | 3.2 |
| 693 | MGSWVEFEYRLDAITERLLALGGSEAELAAFEKEIAAFESE LQAYKGKGNPEVEILREEAAFIRQWLQAYRHN | CD123 | 3.9 |
| 694 | MGSWWEFLDRLDAIEMRLFALGGSEAELAAFEKEIAAFESE LQAYKGKGNPEVEYLREEAALIRNMLQAYRHN | CD123 | 9 |
| 695 | MGSWWEFEDRLDAIEYRLFALGGSEAELAAFEKEIAAFESE LQAYKGKGNPEVEFLREEAAFIRIFLQAYRHN | CD123 | 4.9 |
| 696 | MGSWWEFESRLDAIFMRLTALGGSEAELAAFEKEIAAFESE LQAYKGKGNPEVEDLREDAAFIREFLQAYRHN | CD123 | 3.7 |
| 697 | MGSWVEFWHRLDAIKARLNALGGSEAELAAFEKEIAAFESE LQAYKGKGNPEVEDLRWYAADFRLILQAYRHN | CD123 | 3.5 |
| 698 | MGSWYEFYNRLSAIYARLQALGGSEAELAAFEKEIAAFESE LQAYKGKGNPEVEDLRWYAADIRYMLQAYRHN | CD123 | 10.6 |
| 699 | MGSWYEFYDRLSAIYARLQALGGSEAELAAFEKEIAAFESE LQAYKGKGNPEVEDLRWYAADIRYMLQAYRHN | CD123 | 5.3 |
| 700 | MGSWNEFYDRLSAIYFRLQALGGSEAELAAFEKEIAAFESE LQAYKGKGNPEVEHLRWYAADIRMILQAYRHN | CD123 | 10.6 |
| 701 | MGSWNEFYDRLSAIYFRLQALGGFEAELAAFEKEIAAFESE LQAYKGKGNPEVEHLRWYAADIRMILQAYRHN | CD123 | 9 |
| 702 | MGSWEEFYDRLGAIFARLHALGGSEAELAAFEKEIAAFESE LQAYKGKGNPEVEDLRWYAADIRMILQAYRHN | CD123 | 3.9 |
| 703 | MGSWVEFYDRLHAIYFRLLALGGSEAELAAFEKEIAAFESE LQAYKGKGNPEVEDLRWYAADIRLVLQAYRHN | CD123 | 4.8 |
| 704 | MGSWKEFDNRLYAIEDRLRALGGSEAELAAFEKEIAAFESE LQAYKGKGNPEVEHLRWYAADIRMILQAYRHN | CD123 | 3.9 |
| 705 | MGSWVEFWDRLWAIEDRLWALGGSEAELAAFEKEIAAFESE LQAYKGKGNPEVEHLRHYAADIRVWLQAYRHN | CD123 | 4.5 |
| 706 | MGSWYEFADRLWAIEDRLWALGGSEAELAAFEKEIAAFESE LQAYKGKGNPEVEFLRYYAADIRWVLQAYRHN | CD123 | 4 |
| 707 | MGSWYEFEERLYAIEDRLYALGGSEAELAAFEKEIAAFESE LQAYKGKGNPEVEFLRQEAADIRLMLQAYRHN | CD123 | 11.5 |
| 708 | MGSWTEFEWRLYAIEDRLMALGGSEAELAAFEKEIAAFESE LQAYKGKGNPEVEFLRDEAADIRQYLQAYRHN | CD123 | 4.2 |
| 709 | MGSWIEFESRLWAIEDRLLALGGSEAELAAFEKEIAAFESE LQAYKGKGNPEVEFLRLEAADIREDLQAYRHN | CD123 | 8.7 |
| 710 | MGSWFEFEDRLDAIWDRLWALGGSEAELAAFEKEIAAFESE LQAYKGKGNPEVEFLRMDAAMIRYILQAYRHN | CD123 | 5.1 |

TABLE 1-continued

Exemplary target-specific binding DDs

| SEQ NO: | D-Domain Sequence | Target | ELISA_avg |
|---|---|---|---|
| 711 | MGSWEEFEDRLWAIEDRLWALGGSEAELAAFEKEIAAFESE LQAYKGKGNPEVEILRYDAAYIREILQAYRHN | CD123 | 4.1 |
| 712 | MGSWIEFEDRLYAIEDRLWALGGSEAELAAFEKEIAAFESE LQAYKGKGNPEVEFLRYEAAEIRYWLQAYRHN | CD123 | 4 |
| 713 | MGSWYEFWDRLEAIEDRLWALGGSEAELAAFEKEIAAFESE LQAYKGKGNPEVEFLRYSAAEIRYQLQAYRHN | CD123 | 4.2 |
| 714 | MGSWVEFESRLAAIEHRLWALGGSEAELAAFEKEIAAFESE LQAYKGKGNPEVEELREYAAEIRDWLQAYRHN | CD123 | 3.7 |
| 715 | MGSWWEFEHRLFAIEDRLWALGGSEAELAAFEKEIAAFESE LQAYKGKGNPEVEFLRDYAAEIRDYLQAYRHN | CD123 | 7.6 |
| 716 | MGSWYEFDSRLMAIEDRLWALGGSEAELAAFEKEIAAFESE LQAYKGKGNPEVEYLRQEAAEIRMILQAYRHN | CD123 | 3.2 |
| 717 | MGSWYEFEWRLMAIEDRLWALGGSEAELAAFEKEIAAFESE LQAYKGKGNPEVEYLRHEAAEIRDVLQAYRHN | CD123 | 3.4 |
| 718 | MGSWYEFYNRLDAIEDRLWALGGSEAELAAFEKEIAAFESE LQAYKGKGNPEVEYLRQEAADIRGQLQAYRHN | CD123 | 11.3 |
| 719 | MGSWWEFHDRLEAIEDRLWALGGSEAELAAFEKEIAAFESE LQAYKGKGNPEVEYLRIEAADIRRQLQAYRHN | CD123 | 6.4 |
| 720 | MGSWYEFWDRLEAIEERLWALGGSEAELAAFEKEIAAFESE LQAYKGKGNPEVEYLRLEAADIRRILQAYRHN | CD123 | 4.6 |
| 721 | MGSWYEFEERLWAIEERLYALGGSEAELAAFEKEIAAFESE LQAYKGKGNPEVEYLRYEAAWIRDFLQAYRHN | CD123 | 5.4 |
| 722 | MGSWYEFENRLEAIEERLWALGGSEAELAAFEKEIAAFESE LQAYKGKGNPEVEMLREEAAFIRDWLQAYRHN | CD123 | 6.1 |
| 723 | MGSWYEFEYRLEAIEDRLWALGGSEAELAAFEKEIAAFESE LQAYKGKGNPEVEYLREEAAWIRVWLQAYRHN | CD123 | 6.2 |
| 724 | MGSWYEFENRLGAIGDRLWALGGSEAELAAFEKEIAAFESE LQAYKGKGNPEVEWLRDEAAYIRAVLQAYRHN | CD123 | 4.8 |
| 725 | MGSWYEFEHRLDAIYDRLWALGGSEAELAAFEKEIAAFESE LQAYKGKGNPEVEWLREEAAWIRLWLQAYRHN | CD123 | 6.3 |
| 726 | MGSWYEFEWRLDAIYDRLGALGGSEAELAAFEKEIAAFESE LQAYKGKGNPEVEWLREDAAEIRALLQAYRHN | CD123 | 6 |
| 727 | MGSWVEFENRLEAIENRLWALGGSEAELAAFEKEIAAFESE LQAYKGKGNPEVEWLREDAAQIRMMLQAYRHN | CD123 | 6.2 |
| 728 | MGSWYEFEERLEAIEDRLWALGGSEAELAAFEKEIAAFESE LQAYKGKGNPEVEWLREQAAFIRTMLQAYRHN | CD123 | 6 |
| 729 | MGSWFEFEWRLEAIFDRLYALGGSEAELAAFEKEIAAFESE LQAYKGKGNPEVEVLRAEAAEIRLRLQAYRHN | CD123 | 6.9 |
| 730 | MGSWWEFEDRLMAIYDRLYALGGSEAELAAFEKEIAAFESE LQAYKGKGNPEVEYLRAEAALIRETLQAYRHN | CD123 | 15.3 |
| 731 | MGSWFEFEDRLYAIEDRLYALGGSEAELAAFEKEIAAFESE LQAYKGKGNPEVEYLRWGAATIRDELQAYRHN | CD123 | 4.7 |
| 732 | MGSWIEFWDRLEAIEDRLWALGGSEAELAAFEKEIAAFESE LQAYKGKGNPEVEELRDEAAWIRDSLQAYRHN | CD123 | 4.5 |
| 733 | MGSWFEFWDRLDAIEDRLYALGGSEAELAAFEKEIAAFESE LQAYKGKGNPEVEELRDEAAWIRGTLQAYRHN | CD123 | 4.9 |
| 734 | MGSWEEFTDRLWAIEDRLYALGGSEAELAAFEKEIAAFESE LQAYKGKGNPEVEWLRDEAAFIRKSLQAYRHN | CD123 | 8.9 |
| 735 | MGSWVEFVDRLEAIEDRLFALGGSEAELAAFEKEIAAFESE LQAYKGKGNPEVEFLRDQAAYIRFMLQAYRHN | CD123 | 4.9 |

TABLE 1-continued

Exemplary target-specific binding DDs

| SEQ NO: | D-Domain Sequence | Target | ELISA_avg |
|---|---|---|---|
| 736 | MGSWFEFVDRLEAIEMRLFALGGSEAELAAFEKEIAAFESE LQAYKGKGNPEVELLRWRAAMIRYDLQAYRHN | CD123 | 7.1 |
| 737 | MGSWWEFEMRLEAIEDRLFALGGSEAELAAFEKEIAAFESE LQAYKGKGNPEVESLRWEAAFIRDILQAYRHN | CD123 | 4 |
| 738 | MGSWFEFEIRLEAIEDRLFALGGSEAELAAFEKEIAAFESE LQAYKGKGNPEVEFLRDEAAEIRQVLQAYRHN | CD123 | 3 |
| 739 | MGSWYEFYQRLEAIEDRLFALGGSEAELAAFEKEIAAFESE LQAYKGKGNPEVEWLRDEAAEIRVVLQAYRHN | CD123 | 3 |
| 740 | MGSWIEFEDRLEAIEDRLFALGGSEAELAAFEKEIAAFESE LQAYKGKGNPEVEWLRQEAAEIRLMLQAYRHN | CD123 | 21.8 |
| 741 | MGSWHEFYDRLDAIYFRLWALGGSEAELAAFEKEIAAFESE LQAYKGKGNPEVELLRLLAAEIRKELQAYRHN | p26 | 9.6 |
| 742 | MGSWHEFITRLEAIDQRLWALGGSEAELAAFEKEIAAFESE LQAYKGKGNPEVEYLRFWAAEIRFILQAYRHN | p26 | 16.91 |
| 743 | MGSWMEFFDRLVAIDERLWALGGSEAELAAFEKEIAAFESE LQAYKGKGNPEVEYLRMWAAEIRFLLQAYRHN | p26 | 18.62 |
| 744 | MGSWVEFSGRLIAIDNRLWALGGSEAELAAFEKEIAAFESE LQAYKGKGNPEVEYLRMWAAEIRYILQAYRHN | p26 | 5.28 |
| 745 | MGSWVEFHHRLFAIDERLWALGGSEAELAAFEKEIAAFESE LQAYKGKGNPEVEYLRMVAAEIRYILQAYRHN | p26 | 21.39 |
| 746 | MGSWHEFMERLIAIDGRLWALGGSEAELAAFEKEIAAFESE LQAYKGKGNPEVEYLRFVAAFIRDVLQAYRHN | p26 | 17.85 |
| 747 | MGSWKEFIQRLDAIHYRLWALGGSEAELAAFEKEIAAFESE LQAYKGKGNPEVEYLRFVAAFIRFELQAYRHN | p26 | 18.41 |
| 748 | MGSWSEFIFRLDAIHSRLQALGGSEAELAAFEKEIAAFESE LQAYKGKGNPEVEYLRFIAAEIRLKLQAYRHN | p26 | 28.3 |
| 749 | MGSWFEFYDRLNAIDARLWALGGSEAELAAFEKEIAAFESE LQAYKGKGNPEVENLRVHAAAIREWLQAYRHN | p26 | 5.92 |
| 750 | MGSWLEFYDRLNAIDARLWALGGSEAELAAFEKEIAAFESE LQAYKGKGNPEVENLRVHAAAIREWLQAYRHN | p26 | |
| 751 | MGSWFEFYHRLNAIDARLWALGGSEAELAAFEKEIAAFESE LQAYKGKGNPEVENLRVHAAAIREWLQAYRHN | p26 | |
| 752 | MGSWFEFYDRLNAIDSRLWALGGSEAELAAFEKEIAAFESE LQAYKGKGNPEVENLRVHAAAIREWLQAYRHN | p26 | |
| 753 | MGSWFEFYDRLNAIDARLWALGGSEAELAAFEKEIAAFESE LQAYKGKGNPEVESLRVHAAAIREWLQAYRHN | p26 | |
| 754 | MGSWFEFYDRLNAIDARLWALGGSEAELAAFEKEIAAFESE LQAYKGKGNPEVENLRDHAAAIREWLQAYRHN | p26 | |
| 755 | MGSWFEFYDRLNAIDARLWALGGSEAELAAFEKEIAAFESE LQAYKGKGNPEVENLREHAAAIREWLQAYRHN | p26 | |
| 756 | MGSWFEFYDRLNAIDARLWALGGSEAELAAFEKEIAAFESE LQAYKGKGNPEVENLRVHAAHIREWLQAYRHN | p26 | |
| 757 | MGSWLEFYHRLNAIDSRLWALGGSEAELAAFEKEIAAFESE LQAYKGKGNPEVENLRVHAAAIREWLQAYRHN | p26 | |
| 758 | MGSWLEFYHRLNAIDSRLWALGGSEAELAAFEKEIAAFESE LQAYKGKGNPEVESLRDHAAHIREWLQAYRHN | p26 | 19.23 |
| 759 | MGSWFEFYHRLNAIDSRLWALGGSEAELAAFEKEIAAFESE LQAYKGKGNPEVESLRDHAAHIREWLQAYRHN | p26 | |
| 760 | MGSWLEFYDRLNAIDSRLWALGGSEAELAAFEKEIAAFESE LQAYKGKGNPEVESLRDHAAHIREWLQAYRHN | p26 | |

TABLE 1-continued

Exemplary target-specific binding DDs

| SEQ NO: | D-Domain Sequence | Target | ELISA_avg |
|---|---|---|---|
| 761 | MGSWLEFYHRLNAIDARLWALGGSEAELAAFEKEIAAFESE LQAYKGKGNPEVESLRDHAAHIREWLQAYRHN | p26 | |
| 762 | MGSWLEFYHRLNAIDSRLWALGGSEAELAAFEKEIAAFESE LQAYKGKGNPEVENLRDHAAHIREWLQAYRHN | p26 | |
| 763 | MGSWLEFYHRLNAIDSRLWALGGSEAELAAFEKEIAAFESE LQAYKGKGNPEVESLRVHAAHIREWLQAYRHN | p26 | |
| 764 | MGSWLEFYHRLNAIDSRLWALGGSEAELAAFEKEIAAFESE LQAYKGKGNPEVESLRDHAAAIREWLQAYRHN | p26 | |
| 765 | MGSWFEFYDRLNAIDARLWALGGSEAELAAFEKEIAAFESE LQAYKGKGNPEVESLRDHAAHIREWLQAYRHN | p26 | |
| 766 | MGSWFEFYERLNAIDSRLWALGGSEAELAAFEKEIAAFESE LQAYKGKGNPEVEKLRAHAASIRTWLQAYRHN | p26 | 27.1 |
| 767 | MGSWIEFYWRLEAIDQRLWALGGSEAELAAFEKEIAAFESE LQAYKGKGNPEVEDLRVHAAAIRWWLQAYRHN | p26 | 9.4 |
| 768 | MGSWSEFVKRLDAIDQRLWALGGSEAELAAFEKEIAAFESE LQAYKGKGNPEVESLRVHAAAIRAWLQAYRHN | p26 | 27 |
| 769 | MGSWEEFYYRLEAIDARLFALGGSEAELAAFEKEIAAFESE LQAYKGKGNPEVEELRVHAAHIRDWLQAYRHN | p26 | 30.3 |
| 770 | MGSWVEFHYRLQAIDARLWALGGSEAELAAFEKEIAAFESE LQAYKGKGNPEVEELRVHAAHIRKWLQAYRHN | p26 | 14.8 |
| 771 | MGSWVEFVGRLNAIDARLWALGGSEAELAAFEKEIAAFESE LQAYKGKGNPEVEELRHHAAEIRNWLQAYRHN | p26 | 26 |
| 772 | MGSWNEFMDRLNAIDNRLWALGGSEAELAAFEKEIAAFESE LQAYKGKGNPEVENLRKQAASIRLWLQAYRHN | p26 | 10 |
| 773 | MGSWNEFFQRLNAIDERLWALGGSEAELAAFEKEIAAFESE LQAYKGKGNPEVEDLRQHAANIRWWLQAYRHN | p26 | 28.7 |
| 774 | MGSWYEFVVRLFAIDERLWALGGSEAELAAFEKEIAAFESE LQAYKGKGNPEVESLREHAAHIRSWLQAYRHN | p26 | 18.25 |
| 775 | MGSWYEFYLRLDAIDHRLWALGGSEAELAAFEKEIAAFESE LQAYKGKGNPEVEMLREHAAHIRKWLQAYRHN | p26 | 16 |
| 776 | MGSWYEFRARLLAIDERLWALGGSEAELAAFEKEIAAFESE LQAYKGKGNPEVEHLREHAAHIRNFLQAYRHN | p26 | 20.9 |
| 777 | MGSWTEFWHRLEAIDSRLWALGGSEAELAAFEKEIAAFESE LQAYKGKGNPEVESLREHAAHIRVWLQAYRHN | p26 | 13.19 |
| 778 | MGSWTEFQNRLNAIDHRLWALGGSEAELAAFEKEIAAFESE LQAYKGKGNPEVESLREHAAKIRVWLQAYRHN | p26 | 30.5 |
| 779 | MGSWSEFFKRLEAIDRRLWALGGSEAELAAFEKEIAAFESE LQAYKGKGNPEVEELREHAAHIRVWLQAYRHN | p26 | 30.2 |
| 780 | MGSWYEFQQRLEAIDTRLWALGGSEAELAAFEKEIAAFESE LQAYKGKGNPEVEELREHAAHIRHWLQAYRHN | p26 | 27.3 |
| 781 | MGSWTEFEKRLHAIDYRLWALGGSEAELAAFEKEIAAFESE LQAYKGKGNPEVEDLREHAAAIRHWLQAYRHN | p26 | 17.1 |
| 782 | MGSWTEFHQRLDAIDERLWALGGSEAELAAFEKEIAAFESE LQAYKGKGNPEVEFLREHAAKIRMWLQAYRHN | p26 | 24.4 |
| 783 | MGSWLEFSQRLTAIDSRLWALGGSEAELAAFEKEIAAFESE LQAYKGKGNPEVENLREHAAKIRNWLQAYRHN | p26 | 30.4 |
| 784 | MGSWTEFVNRLYAIDSRLWALGGSEAELAAFEKEIAAFESE LQAYKGKGNPEVEGLRTHAAKIRHWLQAYRHN | p26 | 16.7 |
| 785 | MGSWMEFVDRLSAIDRRLWALGGSEAELAAFEKEIAAFESE LQAYKGKGNPEVEVLREHAANIRQWLQAYRHN | p26 | 32.1 |

TABLE 1-continued

Exemplary target-specific binding DDs

| SEQ NO: | D-Domain Sequence | Target | ELISA_avg |
|---|---|---|---|
| 786 | MGSWVEFVSRLYAIDFRLWALGGSEAELAAFEKEIAAFESELQAYKGKGNPEVEALREHAAQIRDWLQAYRHN | p26 | 29 |
| 787 | MGSWSEFHTRLDAIDTRLWALGGSEAELAAFEKEIAAFESELQAYKGKGNPEVEDLRRHAAAIRFWLQAYRHN | p26 | 23.5 |
| 788 | MGSWLEFHSRLDAIDTRLWALGGSEAELAAFEKEIAAFESELQAYKGKGNPEVEKLREHAAAIRHYLQAYRHN | p26 | 30.8 |
| 789 | MGSWTEFYQRLDAIDTRLWALGGSEAELAAFEKEIAAFESELQAYKGKGNPEVEGLRQQAAQIRAWLQAYRHN | p26 | 29.7 |
| 790 | MGSWAEFSDRLNAIDQRLWALGGSEAELAAFEKEIAAFESELQAYKGKGNPEVEILREHAAEIRKFLQAYRHN | p26 | 25.3 |
| 791 | MGSWMEFNHRLQAIDGRLWALGGSEAELAAFEKEIAAFESELQAYKGKGNPEVEMLREHAAAIRAFLQAYRHN | p26 | 33.4 |
| 792 | MGSWYEFYKRLEAIDNRLYALGGSEAELAAFEKEIAAFESELQAYKGKGNPEVEYLREHAAAIRHWLQAYRHN | p26 | 30.8 |
| 793 | MGSWYEFYYRLEAIDNRLIALGGSEAELAAFEKEIAAFESELQAYKGKGNPEVEVLREHAAKIREWLQAYRHN | p26 | 29.6 |
| 794 | MGSWYEFVSRLEAIDDRLYALGGSEAELAAFEKEIAAFESELQAYKGKGNPEVEMLRQHAAAIRHWLQAYRHN | p26 | 33.1 |
| 795 | MGSWYEFSHRLEAIEDRLFALGGSEAELAAFEKEIAAFESELQAYKGKGNPEVEPLREHAAYIRHWLQAYRHN | p26 | 26 |
| 796 | MGSWFEFFERLAAIEDRLWALGGSEAELAAFEKEIAAFESELQAYKGKGNPEVESLRVHAAAIRAFLQAYRHN | p26 | 20.3 |
| 797 | MGSWIEFKYRLDAIEWRLEALGGSEAELAAFEKEIAAFESELQAYKGKGNPEVESLRIHAAAIRTWLQAYRHN | p26 | 18.3 |
| 798 | MGSWYEFMYRLDAIEYRLFALGGSEAELAAFEKEIAAFESELQAYKGKGNPEVESLRIHAAMIREWLQAYRHN | p26 |

TABLE 1-continued

Exemplary target-specific binding DDs

| SEQ NO: | D-Domain Sequence | Target | ELISA_avg |
|---|---|---|---|
| 811 | MGSWHEFYDRLYAIWDRLDALGGSEAELAAFEKEIAAFESE LQAYKGKGNPEVEGLRNAAAVIRIFLQAYRHN | p26 | 22.91 |
| 812 | MGSWFEFSNRLYAIWHRLTALGGSEAELAAFEKEIAAFESE LQAYKGKGNPEVESLRTQAAFIRILLQAYRHN | p26 | 15.25 |
| 813 | MGSWFEFSDRLYAIWERLDALGGSEAELAAFEKEIAAFESE LQAYKGKGNPEVESLRFQAAFIRYQLQAYRHN | p26 | 18.99 |
| 814 | MGSWFEFEDRLFAIWTRLEALGGSEAELAAFEKEIAAFESE LQAYKGKGNPEVESLRQSAASIRWLLQAYRHN | p26 | 10.89 |
| 815 | MGSWHEFSERLFAIWTRLEALGGSEAELAAFEKEIAAFESE LQAYKGKGNPEVEALRQSAAFIRVMLQAYRHN | p26 | 8.21 |
| 816 | MGSWGEFTVRLYAIDRRLDALGGSEAELAAFEKEIAAFESE LQAYKGKGNPEVEELRRFAAIIRAFLQAYRHN | p26 | 8.54 |
| 817 | MGSWYEFDHRLMAISFRLVALGGSEAELAAFEKEIAAFESE LQAYKGKGNPEVETLRRRAANIRHLLQAYRHN | p26 | 20.1 |
| 818 | MGSWSIFKYHLADIKLLLEALGGSEAELAYFEFLIADFEFT LQDYKGKGNPEVEALRKEAAAIRDELQAYRHN | p26 | 20.21 |
| 819 | MGSWHHFKYFLADIKSILEALGGSEAELAIFEVQIAYFEDL LQSYKGKGNPEVEALRKEAAAIRDELQAYRHN | p26 | 8 |
| 820 | MGSWLYFKYNLAVIKHWLEALGGSEAELAIFEMSIADFEYE LQWYKGKGNPEVEALRKEAAAIRDELQAYRHN | p26 | 13.3 |
| 821 | MGSWFYFKYELAWIKHWLEALGGSEAELASFETHIAFFEHQ LQYYKGKGNPEVEALRKEAAAIRDELQAYRHN | p26 | 13.7 |
| 822 | MGSWADFKWTLAYIKHRLEALGGSEAELAFFEMEIAYFEQS LQNYKGKGNPEVEALRKEAAAIRDELQAYRHN | p26 | 31.5 |
| 823 | MGSWAYFKGQLAYIKSGLEALGGSEAELAYFELRIAYFEHW LQNYKGKGNPEVEALRKEAAAIRDELQAYRHN | p26 | 11.4 |
| 824 | MGSWENFKDTLAWIKEYLEALGGSEAELAGFEHRIAIFEHY LQYYKGKGNPEVEALRKEAAAIRDELQAYRHN | p26 | 19.2 |
| 825 | MGSWVLFKDYLADIKHYLEALGGSEAELANFEHLIANFEGD LQTYKGKGNPEVEALRKEAAAIRDELQAYRHN | p26 | 13.8 |
| 826 | MGSWSLFKHRLANIKVYLEALGGSEAELADFETFIAYFEKD LQEYKGKGNPEVEALRKEAAAIRDELQAYRHN | p26 | 19.6 |
| 827 | MGSWEHFKVELAGIKAYLEALGGSEAELALFEWAIADFESI LQDYKGKGNPEVEALRKEAAAIRDELQAYRHN | p26 | 18.1 |
| 828 | MGSWIYFKDELAGIKKYLEALGGSEAELAMFEVAIADFEAI LQKYKGKGNPEVEALRKEAAAIRDELQAYRHN | p26 | 15.9 |
| 829 | MGSWVLFKQELAWIKWLLEALGGSEAELAAFEEQIARFEHD LQKYKGKGNPEVEALRKEAAAIRDELQAYRHN | p26 | 29.5 |
| 830 | MGSWVLFKQELAWIKWYLEALGGSEAELAAFEWEIAAFEQR LQIYKGKGNPEVEALRKEAAAIRDELQAYRHN | p26 | 22.5 |
| 831 | MGSWFLFKSELAWIKWRLEALGGSEAELAYFEYQIAEFEFW LQSYKGKGNPEVEALRKEAAAIRDELQAYRHN | p26 | 25.8 |
| 832 | MGSWLLFKSELAWIKWYLEALGGSEAELAEFEWNIAEFEKN LQKYKGKGNPEVEALRKEAAAIRDELQAYRHN | p26 | 25.7 |
| 833 | MGSWLLFKSDLAWIKWRLEALGGSEAELAEFEESIAMFEHW LQEYKGKGNPEVEALRKEAAAIRDELQAYRHN | p26 | 33.3 |
| 834 | MGSWLYFKSDLAWIKWRLEALGGSEAELADFEEAIAEFEQA LQIYKGKGNPEVEALRKEAAAIRDELQAYRHN | p26 | 21.2 |
| 835 | MGSWKLFKYELAWIKWRLEALGGSEAELADFEASIAQFEKY LQTYKGKGNPEVEALRKEAAAIRDELQAYRHN | p26 | 23.4 |

TABLE 1-continued

Exemplary target-specific binding DDs

| SEQ NO: | D-Domain Sequence | Target | ELISA_avg |
|---|---|---|---|
| 836 | MGSWYLFKNELAWIKWRLEALGGSEAELADFEMVIAMFEDHLQEYKGKGNPEVEALRKEAAAIRDELQAYRHN | p26 | 31.1 |
| 837 | MGSWVYFKAHLAFIKWELEALGGSEAELANFESTIAEFEKYLQVYKGKGNPEVEALRKEAAAIRDELQAYRHN | p26 | 20.8 |
| 838 | MGSWMYFKSHLAWIKWELEALGGSEAELAFFEDNIAQFEYWLQLYKGKGNPEVEALRKEAAAIRDELQAYRHN | p26 | 19.8 |
| 839 | MGSWTLFKWDLAFIKWQLEALGGSEAELAWFEYEIAAFEDSLQNYKGKGNPEVEALRKEAAAIRDELQAYRHN | p26 | 12.1 |
| 840 | MGSWILFKEDLAFIKWQLEALGGSEAELAWFETTIANFESDLQKYKGKGNPEVEALRKEAAAIRDELQAYRHN | p26 | 23.3 |
| 841 | MGSWYFFKSRLAYIKVYLEALGGSEAELAGFEWEIAHFEEWLQRYKGKGNPEVEALRKEAAAIRDELQAYRHN | p26 | 30.1 |
| 842 | MGSWYIFKSELAWIKWYLEALGGSEAELANFEVEIATFETWLQGYKGKGNPEVEALRKEAAAIRDELQAYRHN | p26 | 29.6 |
| 843 | MGSWYIFKQELASIKLSLEALGGSEAELAHFEAEIAWFEWWLQWYKGKGNPEVEALRKEAAAIRDELQAYRHN | p26 | 19.4 |
| 844 | MGSWVRFKTELAYIKESLEALGGSEAELAMFESEIAIFEHSLQTYKGKGNPEVEALRKEAAAIRDELQAYRHN | p26 | 20.5 |
| 845 | MGSWYLFKTELAAIKYRLEALGGSEAELASFEYEIAWFEHILQFYKGKGNPEVEALRKEAAAIRDELQAYRHN | p26 | 20.1 |
| 846 | MGSWYWFKYELAEIKWHLEALGGSEAELAHFEHSIAVFESQLQQYKGKGNPEVEALRKEAAAIRDELQAYRHN | p26 | 21.5 |
| 847 | MGSWWVFKKTLAEIKWTLEALGGSEAELAYFEAEIAFFEFILQQYKGKGNPEVEALRKEAAAIRDELQAYRHN | p26 | 18.6 |
| 848 | MGSWVYFKDHLAEIKSQLEALGGSEAELALFEYDIAWFEFILQYYKGKGNPEVEALRKEAAAIRDELQAYRHN | p26 | 22.1 |
| 849 | MGSWVYFKHRLAEIKDQLEALGGSEAELAEFETDIAWFEWMLQYYKGKGNPEVEALRKEAAAIRDELQAYRHN | p26 | 11.1 |
| 850 | MGSWIIFKTDLARIKNYLEALGGSEAELATFERDIAWFEFMLQIYKGKGNPEVEALRKEAAAIRDELQAYRHN | p26 | 16.7 |
| 851 | MGSWMHFKQDLAEIKGYLEALGGSEAELAIFEMDIAWFEYMLQYYKGKGNPEVEALRKEAAAIRDELQAYRHN | p26 | 18.9 |
| 852 | MGSWQIFKQDLAAIKDYLEALGGSEAELAIFEFDIAWFEHMLQWYKGKGNPEVEALRKEAAAIRDELQAYRHN | p26 | 17.4 |
| 853 | MGSWLAFKEDLAHIKSILEALGGSEAELAEFEHDIAWFEYMLQYYKGKGNPEVEALRKEAAAIRDELQAYRHN | p26 | 18.6 |
| 854 | MGSWFVFKEDLAGIKFILEALGGSEAELAMFETDIAWFEYMLQYYKGKGNPEVEALRKEAAAIRDELQAYRHN | p26 | 14.2 |
| 855 | MGSWTHFKEDLAHIKDRLEALGGSEAELAAFELDIAWFEFMLQYYKGKGNPEVEALRKEAAAIRDELQAYRHN | p26 | 30.4 |
| 856 | MGSWYYFK TABLE 1-continued Exemplary target-specific binding DDs

| SEQ NO: | D-Domain Sequence | Target | ELISA_avg |
|---|---|---|---|
| 861 | MGSWSYFKEDLANIKSSLEALGGSEAELAWFESSIAWFEHT LQYYKGKGNPEVEALRKEAAAIRDELQAYRHN | p26 | 11.6 |
| 862 | MGSWSIFKQDLADIKDSLEALGGSEAELAMFEMDIAWFEHT LQYYKGKGNPEVEALRKEAAAIRDELQAYRHN | p26 | 16.6 |
| 863 | MGSWEIFKDDLASIKKVLEALGGSEAELALFESDIAWFELM LQYYKGKGNPEVEALRKEAAAIRDELQAYRHN | p26 | 27.9 |
| 864 | MGSWSIFKDDLAVIKERLEALGGSEAELAHFEQDIAWFEHL LQYYKGKGNPEVEALRKEAAAIRDELQAYRHN | p26 | 25.6 |
| 865 | MGSWSVFKDDLAQIKDRLEALGGSEAELAQFELDIAWFEYV LQFYKGKGNPEVEALRKEAAAIRDELQAYRHN | p26 | 30.3 |
| 866 | MGSWAVFKDSLAHIKDVLEALGGSEAELALFEMDIAWFEYV LQDYKGKGNPEVEALRKEAAAIRDELQAYRHN | p26 | 24.1 |
| 867 | MGSWIAFKDHLAIIKQRLEALGGSEAELARFEFEIAWFEWM LQYYKGKGNPEVEALRKEAAAIRDELQAYRHN | p26 | 29.9 |
| 868 | MGSWIHFKNDLAVIKDELEALGGSEAELARFEIMIAWFEDA LQWYKGKGNPEVEALRKEAAAIRDELQAYRHN | p26 | 17.9 |
| 869 | MGSWMVFKQDLAEIKANLEALGGSEAELADFEFAIAWFEYE LQWYKGKGNPEVEALRKEAAAIRDELQAYRHN | p26 | 17.8 |
| 870 | MGSWKNFKLELALIKSKLEALGGSEAELAQFEADIAFFEWS LQWYKGKGNPEVEALRKEAAAIRDELQAYRHN | p26 | 20.6 |
| 871 | MGSWHSFKQDLAYIKYLLEALGGSEAELAQFEELIAFFEYY LQTYKGKGNPEVEALRKEAAAIRDELQAYRHN | p26 | 25.6 |
| 872 | MGSWVVFKSSLAQIKILLEALGGSEAELAIFEVKIAHFEQE LQEYKGKGNPEVEALRKEAAAIRDELQAYRHN | p26 | 8.6 |
| 873 | MGSWDQFKNSLASIKRVLEALGGSEAELAIFEVKIAHFEHF LQQYKGKGNPEVEALRKEAAAIRDELQAYRHN | p26 | 15.6 |
| 874 | MGSWNNFKSSLASIKQVLEALGGSEAELAVFELQIAHFERE LQYYKGKGNPEVEALRKEAAAIRDELQAYRHN | p26 | 24.1 |
| 875 | MGSWVEFGHRLWAIDQRLYALGGSEAELAAFEKEIAAFESE LQAYKGKGNPEVEKLRQRAAFIRFRLQAYRHN | CD137 | |
| 876 | MGSWAEFKQRLAAIKTRLEALGGSEAELAAFLGEIWAFEME LAAYKGKGNPEVEALGREAAAIRMELQAYRHN | CD137 (BB10) | |
| 877 | MGSWYEFDLRLHAIYDRLVALGGSEAELAAFEKEIAAFESE LQAYKGKGNPEVEILRDNAAYIRQMLQAYRHN | CD47 | |
| 878 | MGSWHEFHDRLQAIHERLYALGGSEAELAAFEKEIAAFESE LQAYKGKGNPEVESLRIAAAHIRQVLQAYRHN | CTLA4 | |
| 879 | MGSWNYFKDHLAWIKNSLEALGGSEAELAHFETAIASFERQ LQEYKGKGNPEVEALRKEAAAIRDELQAYRHN | DRS | |
| 880 | MGSWLWFKIFLAEIKYFLEALGGSEAELAAFDFEIHAFHVE LFAYKGKGNPEVEVLREVAAEIRWDLQAYRHN | KIR | |
| 881 | MGSWTEFQSRLDAIHSRLRALGGSEAELAAFEKEIAAFESE LQAYKGKGNPEVELLRDDAAFIRHFLQAYRHN | PDL1 | |
| 882 | MGSWVVFKVDLATIKYILEALGGSEAELAEFEGEIAGFEYS LQFYKGKGNPEVEALRKEAAAIRDELQAYRHN | TIM3 | |
| 883 | MGSWTIFKEWLAFIKTDLEALGGSEAELAFFEGWIASFEME LQKYKGKGNPEVEALRKEAAAIRDELQAYRHN | PD1 | |
| 884 | MGSWEEFELRLNAIEERLYALGGSEAELAYFEYVIADFEGN LQRYKGKGNPEVEALYFEADAIFEELVAYRHN | CD19 | |
| 885 | MGSWVVFKQRLAYIKDLLEALGGSEAELAYFEMSIAFFEED LQVYKGKGNPEVEALRKEAAAIRDELQAYRHN | CD22 | |

TABLE 1-continued

Exemplary target-specific binding DDs

| SEQ NO: | D-Domain Sequence | Target | ELISA_avg |
|---|---|---|---|
| 886 | MGSWVEFYERLDAIDRRLWALGGSEAELAAFEKEIAAFESELQAYKGKGNPEVEELRVHAASIRAWLQAYRHN | p26 | |
| 887 | MGSWFEFYDRLNAIDARLWALGGSEAELAAFEKEIAAFESELQAYKGKGNPEVESLRAHAAAIREWLQAYRHN | p26 | |
| 888 | MGSWSEFYDRLNAIDARLWALGGSEAELAAFEKEIAAFESELQAYKGKGNPEVESLRVHAAAIREWLQAYRHN | p26 | |
| 889 | MGSWSEFYDRLNAIDARLWALGGSEAELAAFEKEIAAFESELQAYKGKGNPEVESLRAHAAAIREWLQAYRHN | p26 | |
| 890 | MGSWSEFYDRLNAIDARLWALGGSEAELAAFEKEIAAFESELQAYKGKGNPEVESLKAHAAAIREWLQAYRHN | p26 | |
| 891 | MGSWSEFYDRLNAIDARLWALGGSEAELAAFEKEIAAFESELQAYKGKGNPEVESLQAHAAAIREWLQAYRHN | p26 | |
| 892 | MGSWSEFYDRLNAIDARLWALGGSEAELAAFEKEIAAFESELQAYKGKGNPEVESLRAHAAGIREWLQAYRHN | p26 | |
| 893 | MGSWFEFYDRLNAIDARLWALGGSEAELAAFEKEIAAFESELQAYKGKGNPEVESLREHAAHIREWLQAYRHN | p26 | |
| 894 | MGSWFEFYDRLNAIDARLWALGGSEAELAAFEKEIAAFESELQAYKGKGNPEVESLREHAAAIREWLQAYRHN | p26 | |
| 895 | MGSWSEFYDRLNAIDARLWALGGSEAELAAFEKEIAAFESELQAYKGKGNPEVESLREHAAAIREWLQAYRHN | p26 | |
| 896 | MGSWVEFEARLSAIYERLEALGGSEAELAAFEKEIAAFESELQAYKGKGNPEVEKLRRHAAGIRSNLQAYRHN | CS1 | |
| 897 | MGSWVEFFVRLDAIWERLEALGGSEAELAAFEKEIAAFESELQAYKGKGNPEVETLRFHAAGIRQKLQAYRHN | CS1 | |
| 898 | MGSWTEFNLRLDAIYERLEALGGSEAELAAFEKEIAAFESELQAYKGKGNPEVEALRWHAAGIRQQLQAYRHN | CS1 | |
| 899 | MGSWMEFYDRLDAIWVRLEALGGSEAELAAFEKEIAAFESELQAYKGKGNPEVEVLRFHAAGIREQLQAYRHN | CS1 | |
| 900 | MGSWHEFNGRLWAIYARLDALGGSEAELAAFEKEIAAFESELQAYKGKGNPEVETLRRHAAGIRGILQAYRHN | CS1 | |
| 901 | MGSWYEFVQRLHAINDRLSALGGSEAELAAFEKEIAAFESELQAYKGKGNPEVEVLRRHAAGIRYTLQAYRHN | CS1 | |
| 902 | MGSWAEFYQRLNAIWNRLEALGGSEAELAAFEKEIAAFESELQAYKGKGNPEVEVLRRHAAGIRGQLQAYRHN | CS1 | |
| 903 | MGSWVEFNERLHAIYLRLDALGGSEAELAAFEKEIAAFESELQAYKGKGNPEVETLRRHAAGIRWQLQAYRHN | CS1 | |
| 904 | MGSWNEFKLELAFIKDWLEALGGSEAELANFEEAIAEFEAGLQGYKGKGNPEVEALRKEAAAIRDELQAYRHN | CS1 | |
| 905 | MGSWMEFEARLEAIWDRLEALGGSEAELAAFEKEIAAFESELQAYKGKGNPEVESLRFHAAGIRQHLQAYRHN | CS1 | |
| 906 | MGSWVEFEDRLNAIWWRLEALGGSEAELAAFEKEIAAFESELQAYKGKGNPEVEKLRRHAAGIRTQLQAYRHN | CS1 | |
| 907 | MGSWHHFKMH TABLE 1-continued Exemplary target-specific binding DDs

| SEQ NO: | D-Domain Sequence | Target | ELISA_avg |
|---|---|---|---|
| 911 | MGSWHEFRWRLFAIWQRLHALGGSEAELAAFEKEIAAFESELQAYK GKGNPEVEWLRLDAALIRVMLQAYRHN | HER2 | 10.02 |
| 912 | MGSWAEFRWRLHAIWLKLGELGGSEAELAAFEKEIAAFESELQAYK GKGNPEVEWLREDAEQIKYILQAYRHN | HER2 | |
| 913 | MGSWAEFRWALHAIWLKLGELGGSEAELAAFEKEIAAFESELQAYK GKGNPEVEWLREDAEQIKYILQAYRHN | HER2 | |
| 914 | MGSWAEFRWRLHAIWLKLGALGGSEAELAAFEKEIAAFESELQAYK GKGNPEVEWLRQDAAQIKYILQAYRHN | HER2 | |
| 915 | MGSWAEFRWRLHAIWLQLGALGGSEAELAAFEKEIAAFESELQAYK GKGNPEVEWLRQDAAQIKYILQAYRHN | HER2 | |
| 916 | MGSWAEFRWRLHAIWLRLGALGGTEAELAAFEKEIAAFESELQAYK GKGNPEVEWLRQDAAQIKYILQAYRHN | HER2 | |
| 917 | MGSWAEFRWRLHAIWLRLGALGGSEAELAAFEKEIAAFESELQAYK GKGNPEVEWLRQDAAQIKYILQAYRHN | HER2 | |
| 918 | MGSWAEFRWKLEAIWLRLGALGGSEAELAAFEKEIAAFESELQAYK GKGNPEVEWLRQDAAQIKYILQAYRHN | HER2 | |
| 919 | MGSWAEFRWKLGAIWLRLGALGGSEAELAAFEKEIAAFESELQAYK GKGNPEVEWLRQDAAQIKYILQAYRHN | HER2 | |
| 920 | MGSWYEFRWRLHAIWLRLGALGGSEAELAAFEKEIAAFESELQAYK GKGNPEVEWLRQDAAQIRYILQAYRHN | HER2 | 7.18 |
| 921 | MGSWHEFLRRLLAIEMRLYALGGSEAELAAFEKEIAAFESELQAYK GKGNPEVEHLRVRAASIRQMLQAYRHN | HER2 | 8.15 |
| 922 | MGSWWGFKVNLAWIKWKLEALGGSEAELAYFELWIANFEHSLQEYK GKGNPEVEALRKEAAAIRDELQAYRHN | HER2 | 8.69 |
| 923 | MGSWVNFKTHLARIKVHLEALGGSEAELALFEHDIANFEQVLQQYK GKGNPEVEALRKEAAAIRDELQAYRHN | HER2 | 7.91 |
| 924 | MGSWLVFKDELAGIKNYLEALGGSEAELATFEQDIAWFEQWLQNYK GKGNPEVEALRKEAAAIRDELQAYRHN | HER2 | 3.28 |
| 925 | MGSWKTFKIELAGIKLELEALGGSEAELAGFENAIAQFESSLQYYK GKGNPEVEALRKEAAAIRDELQAYRHN | HER2 | 4.95 |
| 926 | MGSWWEFKVRLSAIQYRLYALGGSEAELAAFEKEIAAFESELQAYK GKGNPEVEALREQAALIRTILQAYRHN | HER2 | 5.17 |
| 927 | MGSWWEFHIRLHAINYRLAALGGSEAELAAFEKEIAAFESELQAYK GKGNPEVEALRELAAKIRGDLQAYRHN | HER2 | 11.90 |
| 928 | MGSWWEFQVRLRAIQYRLNALGGSEAELAAFEKEIAAFESELQAYK GKGNPEVEYLRGLAAQIRFDLQAYRHN | HER2 | 14.39 |
| 929 | MGSWWEFKIRLYAIEYRLNALGGSEAELAAFEKEIAAFESELQAYK GKGNPEVEALRAKAAQIRYNLQAYRHN | HER2 | 4.49 |
| 930 | MGSWFEFNIRLHAIEYRLKALGGSEAELAAFEKEIAAFESELQAYK GKGNPEVEELRNYAASIRKLLQAYRHN | HER2 | 7.86 |
| 931 | MGSWFEFEIRLRAIEYRLSALGGSEAELAAFEKEIAAFESELQAYK GKGNPEVEKLRELAAEIRYALQAYRHN | HER2 | 7.75 |
| 932 | MGSWFEFKIRLYAIQYRLSALGGSEAELAAFEKEIAAFESELQAYK GKGNPEVEELRNLAAEIRHSLQAYRHN | HER2 | 13.08 |
| 933 | MGSWWEFKVRLRAIEYRLSALGGSEAELAAFEKEIAAFESELQAYK GKGNPEVEELRVLAASIRIHLQAYRHN | HER2 | 10.09 |
| 934 | MGSWSEFWFRLHAILYRLQALGGSEAELAAFEKEIAAFESELQAYK GKGNPEVETLRDAAAEIRVALQAYRHN | HER2 | 14.79 |
| 935 | MGSWIEFWVRLNAILYRLYALGGSEAELAAFEKEIAAFESELQAYK GKGNPEVEALRDSAAEIRRWLQAYRHN | HER2 | 3.91 |

TABLE 1-continued

Exemplary target-specific binding DDs

| SEQ NO: | D-Domain Sequence | Target | ELISA_avg |
|---|---|---|---|
| 936 | MGSWVEFWIRLNAIKYRLLALGGSEAELAAFEKEIAAFESELQAYKGKGNPEVEKLRQDAADIRELLQAYRHN | HER2 | 10.62 |
| 937 | MGSWTEFWWRLSAIVYRLNALGGSEAELAAFEKEIAAFESELQAYKGKGNPEVEELRDMAADIRSLLQAYRHN | HER2 | 5.76 |
| 938 | MGSWWEFYLRLRAISYRLQALGGSEAELAAFEKEIAAFESELQAYKGKGNPEVEGLRQDAAEIRKLLQAYRHN | HER2 | 5.10 |
| 939 | MGSWWEFHVRLRAIEYRLEALGGSEAELAAFEKEIAAFESELQAYKGKGNPEVEQLRLIAANIRHLLQAYRHN | HER2 | 5.48 |
| 940 | MGSWWEFHVRLKAIEYRLLALGGSEAELAAFEKEIAAFESELQAYKGKGNPEVEDLRYIAANIRQLLQAYRHN | HER2 | 4.56 |
| 941 | MGSWWEFKVRLKAIEYRLLALGGSEAELAAFEKEIAAFESELQAYKGKGNPEVEDLRYIAANIRQLLQAYRHN | HER2 | |
| 942 | MGSWWEFQVRLAAIEYRLKALGGSEAELAAFEKEIAAFESELQAYKGKGNPEVENLRQLAAHIRSVLQAYRHN | HER2 | 6.33 |
| 943 | MGSWWEFQVRLSAIEYRLTALGGSEAELAAFEKEIAAFESELQAYKGKGNPEVEELRQKAARIRSLLQAYRHN | HER2 | 9.61 |
| 944 | MGSWWEFNIRLHAIDYRLKALGGSEAELAAFEKEIAAFESELQAYKGKGNPEVELLREKAAQIRAQLQAYRHN | HER2 | 9.75 |
| 945 | MGSWWEFRVRLEAIDYRLKALGGSEAELAAFEKEIAAFESELQAYKGKGNPEVEYLRMKAATIRAILQAYRHN | HER2 | 6.82 |
| 946 | MGSWYEFDIRLEAIKYRLSALGGSEAELAAFEKEIAAFESELQAYKGKGNPEVEYLRKKAAVIRSMLQAYRHN | HER2 | 5.35 |
| 947 | MGSWWEFRIRLEAIWYRLHALGGSEAELAAFEKEIAAFESELQAYKGKGNPEVEDLRIFAANIRSKLQAYRHN | HER2 | 8.04 |
| 948 | MGSWWEFNVRLQAIKYRLSALGGSEAELAAFEKEIAAFESELQAYKGKGNPEVEDLRKTAAHIRWQLQAYRHN | HER2 | 5.23 |
| 949 | MGSWWEFNVRLSAIRYRLLALGGSEAELAAFEKEIAAFESELQAYKGKGNPEVEDLRASAAQIRAMLQAYRHN | HER2 | 6.73 |
| 950 | MGSWWEFNMRLSAIKYRLYALGGSEAELAAFEKEIAAFESELQAYKGKGNPEVEILRRLAADIRERLQAYRHN | HER2 | 3.08 |

In some embodiments, the disclosure provides compositions comprising one or more of the DD sequences disclosed on Table 1. In other embodiments, the disclosure provides compositions comprising one or more DDs comprising a sequence with 60-70%, 70-75%, 75-80%, 80-85%, 85-90%, 95-99% homology (and overlapping ranges therein) with a sequence disclosed in Table 1. In some embodiments, the DD(s) having such homology are functionally similar or identical as compared to the respective reference sequence in Table 1. In some embodiments, the disclosure provides a polypeptide that comprises one or more DD that compete with (wholly or partially) one or more of the DD sequences disclosed in Table 1 (reference sequence) for its respective target. The ability of one polypeptide to compete with a reference polypeptide for binding to a respective target can routinely be determined using a standard competition assay known in the art. In some embodiments, competition does not require that the polypeptide competes for the same epitope as a polypeptide (DD) of Table 1, rather the polypeptide can compete by binding a sterically inhibiting epitope, an overlapping epitope, etc.

Affinity Maturation and De-Immunization of DD and DDpp

Affinity maturation strategies can be used to generate high affinity DD and DDpp that can be used in the DDpp fusion proteins described herein. An improved DD and DDpp that specifically binds a desired target (e.g., BCAM, CD123, CS1, HER2, AFP, and AFP p26) can also be prepared based on a known DDpp reference sequence. For example, at least one, two, three, four, five, or more amino acid mutations (e.g., conservative or non-conservative substitutions), deletions or insertions can be introduced into a DD sequence disclosed in Table 1 (i.e., a reference sequence) and the resulting DDpp can be screened for binding to the respective target and biological activity, such as the ability to antagonize the biological activity of the respective target or agonize the biological activity of the respective target.

The disclosed DDpp, particularly those administered to a subject, are preferably not antigenic with respect to the subject (e.g., human) In some embodiments, the sequence of the DDpp does not contain a human HLA-DR binding motif or cleavage sites for proteasomes and immune-proteasomes. In particular embodiments, the DDpp sequence does not contain an antigenic sequence as determined by a computer prediction model version existent on the filing date of this specification. In particular embodiments, the DDpp sequence does not contain an MHC (class I or class II) binding site sequence as predicted by an algorithm selected from ProPred (see, e.g., Singh, Bioinformatics 17(12): 1236-

1237 (2001)), ProPred1 (Singh, Bioinformatics 19(8): 1009-14 (2003)), SYFPEITHI (see, e.g., Schuler, Immunoinf. Meth. in Mol. Biol. 409(1): 75-93 (2007)), SMM-align (see, e.g., Nielsen, BMC Bioinformatics 8: 238 (2007)), RANK-PEP (see, e.g., Reche, Hum Immunol 63: 701-709. (2004)), or TEPITOPE (see, Sturniolo, Nat Biotechnol 17: 555-561 (1999)), wherein the version of the algorithm and the applied database are in existence on the filing date of this application. In some embodiments, the DDpp does not contain a sequence that shares characteristics with a high affinity (binding threshold less than 6%) T cell epitope. (Singh, Bioinformatics 17: 1236-1237 (2001)). In some embodiments, the DDpp does not contain a sequence that shares characteristics with a promiscuous (present in greater than 50% of relevant alleles) T cell epitope (Singh, Bioinformatics 17: 1236-1237 (2001)). In some embodiments, the DDpp does not contain a sequence that shares characteristics with a high affinity or a promiscuous T cell epitope. In particular embodiments, the DDpp does not contain the sequence LAAIKTRLQ (SEQ ID NO: 2). Techniques for generating, screening, and identifying affinity matured DDpp variants and target-binding DDpp variants containing a sequence alteration that removes a predicted MHC (class I or class II) binding site sequence are known in the art.

Articles of Manufacture

Articles of manufacture, including, kits, are provided herein. The article of manufacture may comprise a container and a label or package insert on or associated with the container. Suitable containers include, for example, bottles, vials or syringes. The containers may be formed from a variety of materials such as glass or plastic. The container holds one or more DDpp, nucleic acids encoding DDpp and/or vectors or host cells of the present disclosure. The label or package insert may include directions for performing affinity based screening and/or detection.

Also provided are kits containing a DDpp. Such kits have uses including, but not limited to detecting the target of interest to which the DDpp specifically binds (e.g., BCMA, CD123, CS1, HER2, AFP, or AFP p26)). Such assay kit may be useful in screening for the presence of a target of interest and/or quantitating the concentrations of a target of interest in a fluid, such as, a biological fluid (e.g., blood, serum, or synovial fluid).

In one embodiment a DDpp assay kit is contemplated which comprises one or more containers of a DDpp that specifically binds a target of interest and, optionally, a detection means for determining the presence or absence of a target/DDpp interaction or the absence thereof. The kit further optionally contains target of interest protein (e.g., BCMA, CD123, CS1, HER2, AFP, or AFP p26) that may be used, for example as a control or standard. The DDpp may be free or expressed on the surface of a host cell or on the surface of a bacteriophage. In a specific embodiment, the DDpp or target of interest provided in the kit is labeled. Any label known in the art can be used. In some embodiments, the label is selected from the group consisting of biotin, a fluorogen, an enzyme, an epitope, a chromogen, or a radionuclide. In some embodiments, the DDpp is immobilized on a solid support. The detection means employed to detect the label will depend on the nature of the label and can be any known in the art, e.g., film to detect a radionuclide; an enzyme substrate that gives rise to or amplifies a detectable signal to detect the presence of a target of interest.

Preferably, the kit further comprises a solid support for the DDpp, which may be provided as a separate element or on which a DDpp that specifically binds a target of interest (e.g., BCMA, CD123, CS1, HER2, AFP, or AFP p26) is immobilized. Hence, the DDpp that specifically binds the target of interest in the kit may be immobilized on a solid support, or they may be immobilized on such support that is included with the kit or provided separately from the kit. Preferably, DDpp is coated on a microtiter plate. In some embodiments, the detection involves a signal amplifying molecule. Where the signal amplifying molecule is an enzyme, the kit optionally further includes substrates and cofactors required by the enzyme, and where the amplifying molecule is a fluorophore. The kit optionally further includes a dye precursor that provides the detectable chromophore.

The kit may also contain instructions for carrying out the assay as well as other additives such as stabilizers, washing and incubation buffers, and the like. The components of the kit will be provided in predetermined ratios, with the relative amounts of the various reagents suitably varied to provide for concentrations in solution of the reagents that substantially maximize the sensitivity of the assay. Particularly, the reagents can be provided as dry powders, usually lyophilized, including excipients, which on dissolution will provide for a reagent solution having the appropriate concentration for combining with the sample to be tested.

Various formats and techniques for binding assays that can be used are known in the art and include but are not limited to, immobilization to filters such as nylon or nitrocellulose; two-dimensional arrays, enzyme linked immunosorbent assay (ELISA), radioimmuno-assay (RIA), competitive binding assays, direct and indirect sandwich assays, immunoprecipitation assays, fluorimetric microvolume assay technology (FMAT™), Luminex™ system assays, fluorescent resonance energy transfer (FRET), bioluminescence resonance energy transfer (BRET), electroimmunoassays, AlphaScreen™, nanoparticle-derived techniques, and surface plasmon resonance (SPR).

Binding assays can be homogeneous or semi-homogeneous. A homogeneous assay is an assay where all the components are mixed together, incubated, and then analyzed. A semi-homogeneous assay is one where the majority of the reaction takes place as a complex mixture, but a washing step is required prior to the addition of a final reagent and analysis, in contrast to a typical stepwise assembly sandwich assay where each component is added then washed off before the next component is added. In some embodiments, the assay is an immunoassay. In certain embodiments, the assay is a semi-homogeneous Enzyme Immuno-Assay (EIA).

Uses

DDpp, whether alone, as fusion proteins, as chemical conjugates or as other embodiments, described herein, have a variety of applications. In some embodiments, DDpp are used as detection reagents, diagnostic reagents or analytical reagents. Some embodiments, have in vivo, in vitro and/or ex vivo applications. Methods that employ the DDpp in vitro can be performed in different formats, such as in microtiter plates, in protein arrays, on biosensor surfaces, on tissue sections, and in additional formats that would be apparent to a person skilled in the art. Likewise, methods that employ the DDpp in vivo can be used in different formats that include but are not limited to DDpp-Fc fusion proteins, CAR cells, and DDpp multi-specific antibodies. In particular embodiments, DDpp such as DDpp fusion proteins are used as a therapeutic agent.

Analytical and Diagnostic Applications

Whether alone, as fusion proteins, as chemical conjugates or as other embodiments, described herein, DDpp have a variety of applications. In some embodiments, DDpp are used as detection reagents of targets of interest in a variety of different sample types.

In one embodiment a DDpp are used to detect targets of interest in solutions involved in manufacturing processes, such as protein expression. Samples may include, but are not limited to, water, buffers, in-process purification samples, bulk drug substance and final drug product. In still additional embodiments, the DDpp can be used to detect contaminants from a sample, such as a water supply source or water (or other fluid) used in manufacturing.

In another embodiment, DDpp are used to detect targets of interest in diagnostic samples. Samples may include, but are not limited to tissue homogenates, cell extracts, biopsy samples, sera, plasma, lymph, blood, blood fractions, urine, synovial fluid, spinal fluid, saliva, mucous, sputum, pleural fluid, nipple aspirates, fluid of the respiratory, intestinal, and genitourinary tracts, tear fluid, breast milk, fluid from the lymphatic system, semen, cerebrospinal fluid, intra-organ system fluid, ascitic fluid, tumor cyst fluid, amniotic fluid, and media or lysate from cultured cells.

In one embodiment, the DDpp are useful for detecting the presence of a factor or multiple factors (e.g., antigens or organisms) in a biological sample. The term "detecting" as used herein encompasses quantitative or qualitative detection. In certain embodiments, a biological sample comprises a cell, tissue or fluid. In certain embodiments, such tissues include normal and/or cancerous tissues.

Various formats and techniques for detection are known in the art and include but are not limited to Western Blot analysis, Immunohistochemistry, ELISA, FACS analysis, enzymatic assays, autoradiography and any of the binding assays mentioned herein.

In one embodiment, a method is provided for detecting a target of interest (e.g., BCMA, CD123, CS1, HER2, AFP, or AFP p26) in a solution containing the target comprising: (a) contacting the solution with a DDpp that specifically binds the target of interest under conditions suitable for specific binding of the DDpp to the target and (b) detecting binding of the DDpp and target. The DDpp may be either free or immobilized. Sufficient time is allowed to permit binding between the target of interest and the DDpp, and non-binding components in the solution or mixture are removed or washed away. The formation of a binding complex between the DDpp and the target of interest can then be detected, for example, by detecting the signal from a label on the DDpp, which is one component of the binding complex. A label may be any label that generates a signal that can be detected by standard methods, such as a fluorescent label, a radioactive compound, or an enzyme that reacts with a substrate to generate a detectable signal. Examples of suitable labels for such purposes are described herein and/or otherwise known in the art.

DDpp that bind to a target of interest such as BCMA, CD123, CS1, HER2, AFP, or AFP p26 can be detectably labeled through the use of radioisotopes, affinity labels (such as biotin, avidin, etc.), enzymatic labels (such as horseradish peroxidase, alkaline phosphatase, etc.) using methods known in the art, such as described in WO00/70023 and (Harlow and Lane (1989) Antibodies, Cold Spring Harbor Laboratory, pp. 1-726).

The detectable marker or label can be any which is capable of producing, either directly or indirectly, a measurable signal, such as a radioactive, chromogenic, luminescence, or fluorescent signal, which can be used to quantitate the amount of bound detectable moiety or label in a sample. Detectable labels known in the art include radioisotopes, such as $^3$H, $^{14}$C, $^{32}$P, $^{35}$S, or $^{125}$I, electrochemiluminescent labels (such as Ruthenium (Ru)-based catalyst in conjunction with substrates, etc.), luminescent or bioluminescent labels (e.g., Europium, Vanadium), fluorescent or chemiluminescent compounds, such as fluorescein isothiocyanate, rhodamine, or luciferin, enzymes (e.g., enzyme, such as alkaline phosphatase, beta-galactosidase, or horseradish peroxidase), colorimetric labels such as colloidal gold, colored glass or plastic beads (e.g., polystyrene, polypropylene, latex, etc.), paramagnetic atoms or magnetic agents, electron-dense reagents, a nano- or micro-bead containing a fluorescent dye, nanocrystals, a quantum dot, a quantum bead, a nanotag, dendrimers with a fluorescent label, a micro-transponder, an electron donor molecule or molecular structure, or a light reflecting particle, the microparticles may be nanocrystals or quantum dots. Nanocrystals are substances that absorb photons of light, then re-emit photons at a different wavelength (fluorophores). In addition, additional fluorescent labels, or secondary antibodies may be conjugated to the nanocrystals. Nanocrystals are commercially available from sources such as Invitrogen and Evident Technologies (Troy, N.Y.). Other labels include E)-5-[2-(methoxycarbonyl) ethenyl]cytidine, which is a nonfluorescent molecule that when subjected to ultraviolet (UV) irradiation yields a product, 3 beta-D-ribofuranosyl-2,7-dioxopyrido[2,3-d]pyrimidine, which displays a strong fluorescence signal.

Competitive inhibition can be determined by any method known in the art, for example, competition ELISA assays. A DDpp, such as a DDpp fusion protein (e.g., a DDpp-Fc, DDpp-CAR, a DDpp-scFv), or other molecule is said to "competitively inhibit" binding of a reference molecule to a given epitope if it binds to that epitope to the extent that it blocks, to some degree, binding of the reference molecule to the epitope. As used herein, a DDpp (e.g., a DDpp fusion protein), or other molecule can be said to competitively inhibit binding of the reference molecule to a given epitope, for example, by at least 90%, at least 80%, at least 70%, at least 60%, at least 50%, by at least 40%, at least 30%, or at least 20%. The terms "compete," "ability to compete" and "competes with" are relative terms used to describe a DDpp, such as a DDpp fusion protein, that produce at least 20%, at least 30%, at least 40%, or at least 50% inhibition of binding of a reference molecule to a target by a DDpp such as a DDpp fusion protein (e.g., a DDpp-Fc, DDpp CAR, a DDpp-scFv, and an antibody-comprising a DDpp) as determined in a standard competition assay as described herein or otherwise known in the art, including, but not limited to, competitive assay systems using techniques such as radioimmunoassays (RIA), enzyme immunoassays (EIA), preferably the enzyme linked immunosorbent assay (ELISA), "sandwich" immunoassays, immunoradiometric assays, fluorescent immunoassays, luminescent, electrochemical luminescent, and immunoelectrophoresis assays. Methods for determining binding and affinity of candidate binding molecules are known in the art and include, but are not limited to, affinity chromatography, size exclusion chromatography, equilibrium dialysis, fluorescent probe displacement, and plasma resonance.

Therapeutics

The DD described herein are useful in a variety of applications including, but not limited to, therapeutic treatment methods, which may be in vitro, ex vivo, or in vivo methods.

The application as a therapeutic entity is an attribute of the target binding specificity of the DDpp. The incorporation of DDpp within various molecular compositions, (e.g., a DDantibody fusions, DD-drug conjugates and DD-chimeric receptors) affords application in a variety of therapeutic indications and modalities, which include, but not limited to soluble and cell-associated compositions.

In one embodiment, the DDpp is a soluble fusion protein made up of an optional epitope tag 10 and a targeting domain that binds to a target that is associated with a disease or disorder of the metabolic, cardiovascular, musculoskeletal, neurological, or skeletal system. In other embodiments, the DDpp is a soluble fusion protein that binds to a target that is associated with yeast, fungal, viral or bacterial infection or disease. In some embodiments, the DDpp is a soluble fusion protein that binds to a target that is associated with a disease or disorder of the immune system.

Also provided are therapeutic compositions useful for practicing therapeutic methods described herein. In one embodiment, therapeutic compositions provided herein contain a physiologically tolerable carrier together with at least one species of DDpp fusion as described herein, dissolved or dispersed therein as an active ingredient. In another embodiment, therapeutic compositions provided herein contain a physiologically tolerable carrier together with at least one species of a DDpp as described herein, dissolved or dispersed therein as an active ingredient. In a preferred embodiment, therapeutic composition is not immunogenic when administered to a human patient for therapeutic purposes.

The preparation of a pharmacological composition that contains active ingredients dissolved or dispersed therein is well understood in the art. Typically such compositions are prepared as sterile injectables either as liquid solutions or suspensions, aqueous or non-aqueous. However, solid forms suitable for solution, or suspensions, in liquid prior to use can also be prepared. The preparation can also be emulsified. Thus, a DDpp-containing composition can take the form of solutions, suspensions, tablets, capsules, sustained release formulations or powders, or other compositional forms. In some embodiments, the DDpp compositions (e.g., a DDpp fusion proteins) are formulated to ensure or optimize distribution in vivo, For example, the blood-brain barrier (BBB) excludes many highly hydrophilic compounds and if so desired, the compositions are prepared so as to increase transfer across the BBB, by for example, formulation in liposomes. For methods of manufacturing liposomes, see, e.g., U.S. Pat. Nos. 4,522,811, 5,374,548, and 5,399,331. The liposomes can comprise one or more moieties that are selectively transported into specific cells or organs, thus enhance targeted drug delivery (see, e.g., Ranade, Clin. Pharmacol. 29: 685 (1989)).

The DDpp (e.g. DDpp fusion protein) can be mixed other active ingredients and/or excipients that are pharmaceutically acceptable and compatible with the active ingredient and in amounts suitable for use in therapeutic methods described herein. Suitable excipients are, for example, water, saline, dextrose, glycerol, ethanol or the like and combinations thereof. In addition, if desired, the composition can contain minor amounts of auxiliary substances such as wetting or emulsifying agents, pH buffering agents and the like which enhance the effectiveness of the active ingredient.

Therapeutic DDpp can include pharmaceutically acceptable salts of the components therein. Pharmaceutically acceptable salts include the acid addition salts (formed with the free amino groups of the polypeptide) that are formed with inorganic acids such as, for example, hydrochloric or phosphoric acids, or such organic acids as acetic, tartaric, mandelic and the like. Salts formed with the free carboxyl groups can also be derived from inorganic bases such as, for example, sodium, potassium, ammonium, calcium or ferric hydroxides, and such organic bases as isopropylamine, trimethylarnine, 2-ethylamino ethanol, histidine, procaine and the like.

Physiologically tolerable carriers are known in the art. Exemplary of liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, propylene glycol, polyethylene glycol, and other solutes.

Liquid compositions can also contain liquid phases in addition to, and to the exclusion of water. Exemplary of such additional liquid phases are glycerin, vegetable oils such as cottonseed oil, organic esters such as ethyl oleate, and water-oil emulsions.

In one embodiment, a therapeutic composition contains a DDpp fusion protein, typically in an amount of at least 0.1 weight percent of DDpp fusion protein per weight of total therapeutic composition. A weight percent is a ratio by weight of DDpp fusion per total composition. Thus, for example, 0.1 weight percent is 0.1 grams of DDpp per 100 grams of total composition.

A DDpp fusion protein-containing therapeutic composition typically contains about 10 micrograms (μg) per milliliter (ml) to about 100 milligrams (mg) per ml of DDpp fusion protein as active ingredient per volume of composition, and more preferably contains about 1 mg/ml to about 10 mg/ml (i.e., about 0.1 to 1 weight percent).

The dosage ranges for the administration of the DDpp (e.g., a DDpp fusion protein) are those large enough to produce the desired effect in which the disease symptoms mediated by the target molecule are ameliorated. The dosage should not be so large as to cause adverse side effects, such as hyperviscosity syndromes, pulmonary edema, congestive heart failure, and the like. Generally, the dosage will vary with the age, condition, sex and extent of the disease in the patient and can be determined by one of skill in the art. The dosage can be adjusted by the individual physician in the event of any complication.

The DDpp (e.g., a DDpp fusion protein) can be administered parenterally by injection or by gradual infusion over time. Although the target molecule can typically be accessed in the body by systemic administration and therefore most often treated by intravenous administration of therapeutic compositions, other tissues and delivery means are contemplated where there is a likelihood that the tissue targeted contains the target molecule. Thus, DDpp can be administered intravenously, intraperitoneally, intramuscularly, subcutaneously, intracavity, transdermally, and can be delivered by peristaltic means. DDpp fusion proteins can also be delivered by aerosol to airways and lungs.

Therapeutic compositions containing a DDpp can be conventionally administered intravenously, as by injection of a unit dose, for example. The term "unit dose" when used in reference to a therapeutic composition provided herein refers to physically discrete units suitable as unitary dosage for the subject, each unit containing a predetermined quantity of active material calculated to produce the desired therapeutic effect in association with the required diluent; e.g., carrier, or vehicle. In some embodiments, therapeutic compositions containing a DDpp are administered subcutaneously.

The DDpp (e.g., a DDpp fusion protein) are administered in a manner compatible with the dosage formulation, and in a therapeutically effective amount. The quantity to be administered depends on the subject to be treated, capacity of the subject's system to utilize the active ingredient of the administered composition, and degree of therapeutic effect desired. Precise amounts of active ingredient required to be administered depend on the judgment of the practitioner and are peculiar to each individual. However, suitable dosage ranges for systemic application are disclosed herein and depend on the route of administration. Suitable regimes for administration are also variable, but are typified by an initial administration followed by repeated doses at one or more hour intervals by a subsequent injection or other administration. Alternatively, continuous intravenous infusion sufficient to maintain concentrations in the blood in the ranges specified for in vivo therapies are contemplated.

The DDpp compositions are formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The dosage ranges for the administration of the DDpp are those large enough to produce the desired effect in which the disease symptoms mediated by the target molecule are ameliorated. The dosage should not be so large as to cause adverse side effects, such as, hyperviscosity syndromes, pulmonary edema, congestive heart failure, and the like. Generally, the dosage will vary with the age, condition, sex and extent of the disease in the patient and can be determined by one of skill in the art. The dosage can be adjusted by the individual physician in the event of any complication.

The dosage schedule and amounts effective for therapeutic and prophylactic uses, i.e., the "dosing regimen," will depend upon a variety of factors, including the cause, stage and severity of the disease or disorder, the health, physical status, age of the mammal being treated, and the site and mode of the delivery of the DD. Therapeutic efficacy and toxicity of the complex and formation can be determined by standard pharmaceutical, pharmacological, and toxicological procedures in cell cultures or experimental animals Data obtained from these procedures can likewise be used in formulating a range of dosages for human use. Moreover, therapeutic index (i.e., the dose therapeutically effective in 50 percent of the population divided by the dose lethal to 50 percent of the population (ED50/LD50)) can readily be determined using known procedures. The dosage is preferably within a range of concentrations that includes the ED50 with little toxicity or none dose limiting toxicity, and may vary within this range depending on the dosage form employed, sensitivity of the patient, and the route of administration.

The dosage regimen also takes into consideration pharmacokinetics parameters known in the art, such as, drug absorption rate, bioavailability, metabolism and clearance (see, e.g., Hidalgo-Aragones, J. Steroid Biochem. Mol. Biol. 58: 611-617 (1996); Groning et al., Pharmazie 51: 337-341 (1996); Fotherby, Contraception 54: 59-69 (1996); and Johnson et al., J. Pharm. Sci. 84: 1144-1146 (1995)). It is well within the state and level of skill of the clinician to determine the dosage regimen for each subject being treated. Moreover, single or multiple administrations of DDpp compositions can be administered depending on the dosage and frequency as required and tolerated by the subject. The duration of prophylactic and therapeutic treatment will vary depending on the particular disease or condition being treated. Some diseases are amenable to acute treatment whereas others require long-term, chronic therapy. DDpp can be administered serially, or simultaneously with the additional therapeutic agent.

In some embodiments, the DDpp is administered at about 1 mg/kg to about 50 mg/kg, about 1 mg/kg to about 25 mg/kg, about 1 mg/kg to about 20 mg/kg, about 1 mg/kg to about 15 mg/kg, about 1 mg/kg to about 10 mg/kg, or about 1 mg/kg to about 5 mg/kg.

In another embodiment, the DDpp is administered in combination with one or more additional therapeutics.

A therapeutically effective amount of the DDpp (e.g., a DDpp fusion protein) can be an amount such that when administered in a physiologically tolerable composition is sufficient to achieve a plasma concentration of from about 0.1 microgram (µg) per milliliter (ml) to about 100 µg/ml, preferably from about 1 µg/ml to about 5 µg/ml, and usually about 5 µg/ml. Stated differently, the dosage can vary from about 0.1 mg/kg to about 300 mg/kg, preferably from about 0.2 mg/kg to about 200 mg/kg, most preferably from about 0.5 mg/kg to about 20 mg/kg, in one or more dose administrations daily, for one or several days.

In some embodiments, the DDpp described herein are useful for treating a disease or disorder of the immune system, such as inflammation or an autoimmune disease.

In some embodiments, the DDpp described herein are useful for treating cancer. Thus, in some embodiments, the disclosure provides a method of treating cancer that comprises administering a therapeutically effective amount of a DDpp (e.g. a DDpp fusion) to a patient.

In additional embodiments, the disclosure provides a chimeric antigen receptor (CAR), wherein the CAR includes a targeting domain, a transmembrane domain, and an intracellular signaling domain. In some embodiments, the targeting domain is made up of, at least in part, a target-binding DDpp disclosed herein.

The disclosure also provides cells comprising a nucleic acid sequence encoding a CAR, wherein the CAR comprises an antigen binding domain made up of, at least in part, a disclosed polypeptide that binds a target of interest (e.g., BCMA, CD123, CS1, HER2, AFP, and AFP p26), a transmembrane domain, and a signaling domain. In some embodiments, the CAR binds specifically to a tumor antigen (and thus functions to deliver the cell expressing the CAR to the tumor. In some embodiments, the tumor antigen is associated with a hematologic malignancy. In some embodiments, the tumor antigen is BCMA. In some embodiments, the tumor antigen is CD123. In some embodiments, the tumor antigen is CS1. In additional embodiments, tumor antigen is associated with a solid tumor. In some embodiments, the tumor antigen is HER2. In some embodiments, both solid and hematologic tumors are targeted. In some embodiments, the cell expressing the CAR is a T cell, a natural killer (NK) cell or other immune cell type. In some embodiments, the cell expressing the CAR (whether T cell, NK cell or other cell type) exhibits an anti-tumor immunity when the polypeptide binds to its corresponding tumor antigen.

In some embodiments, the disclosure provides a method of treating a subject having cancer, comprising administering to the subject a therapeutically effective amount of a CAR immune cell comprising a chimeric antigen receptor (CAR), wherein the CAR comprises a target binding domain that comprises a DD that specifically binds BCMA (e.g., comprising an amino acid sequence selected from the group consisting of SEQ ID NO: 11-305, and 306), a transmembrane domain, and an intracellular domain (comprising a signaling domain) In some embodiments, the administered CAR immune cell is a T cell. In some embodiments, the administered CAR immune cell is a NK cell. In some embodiments, the administered CAR immune cell is not a T cell or an NK cell. In further embodiments, a combination of different CAR immune cell types (e.g., NK cells and T cells) is administered to the subject.

In some embodiments, the target binding domain of the administered CAR immune cell specifically binds BCMA expressed by a cancer cell of the subject, and induces the CAR immune cell to generate a cytotoxic signal that results in cytotoxic effects on the cancer cell, thereby treating the cancer.

In some embodiments, the disclosure provides a method of treating a subject having cancer, comprising administering to the subject a therapeutically effective amount of a CAR immune cell comprising a chimeric antigen receptor (CAR), wherein the CAR comprises a target binding domain that comprises a DD that specifically binds CD123 (e.g., comprising an amino acid sequence selected from the group consisting of SEQ ID NO: 307-739, and 740), a transmembrane domain, and an intracellular domain (comprising a signaling domain) In some embodiments, the administered CAR immune cell is a T cell. In some embodiments, the administered CAR immune cell is a NK cell. In some embodiments, the administered CAR immune cell is not a T cell or an NK cell. In further embodiments, a combination of different CAR immune cell types (e.g., NK cells and T cells) is administered to the subject. In some embodiments, the target binding domain of the administered CAR immune cell specifically binds CD123 expressed by a cancer cell of the subject, and induces the CAR immune cell to generate a cytotoxic signal that results in cytotoxic effects on the cancer cell, thereby treating the cancer.

In some embodiments, the disclosure provides a method of treating a subject having cancer, comprising administering to the subject a therapeutically effective amount of a CAR immune cell comprising a chimeric antigen receptor (CAR), wherein the CAR comprises a target binding domain that comprises a DD that specifically binds CS1 (e.g., comprising an amino acid sequence selected from the group consisting of SEQ ID NO: 896-909, and 910), a transmembrane domain, and an intracellular domain (comprising a signaling domain) In some embodiments, the administered CAR immune cell is a T cell. In some embodiments, the administered CAR immune cell is a NK cell. In some embodiments, the administered CAR immune cell is not a T cell or an NK cell. In further embodiments, a combination of different CAR immune cell types (e.g., NK cells and T cells) is administered to the subject. In some embodiments, the target binding domain of the administered CAR immune cell specifically binds CS1 expressed by a cancer cell of the subject, and induces the CAR immune cell to generate a cytotoxic signal that results in cytotoxic effects on the cancer cell, thereby treating the cancer.

In some embodiments, the disclosure provides a method of treating a subject having cancer, comprising administering to the subject a therapeutically effective amount of a CAR immune cell comprising a chimeric antigen receptor (CAR), wherein the CAR comprises a target binding domain that comprises a DD that specifically binds HER2 (e.g., comprising an amino acid sequence selected from the group consisting of SEQ ID NO: 911-949, and 950), a transmembrane domain, and an intracellular domain (comprising a signaling domain) In some embodiments, the administered CAR immune cell is a T cell. In some embodiments, the administered CAR immune cell is a NK cell. In some embodiments, the administered CAR immune cell is not a T cell or an NK cell. In further embodiments, a combination of different CAR immune cell types (e.g., NK cells and T cells) is administered to the subject. In some embodiments, the target binding domain of the administered CAR immune cell specifically binds HER2 expressed by a cancer cell of the subject, and induces the CAR immune cell to generate a cytotoxic signal that results in cytotoxic effects on the cancer cell, thereby treating the cancer.

Additionally provided are methods for treating or preventing cancer comprising administering a DDpp-CAR T lymphocyte to a patient predisposed to or having a cancer that expresses a tumor antigen on the surface of target cells, and wherein the DDpp specifically binds the antigen.

In some embodiments, wherein CAR T cells are administered to the subject having cancer, the binding of the target of interest (e.g., BCMA, CD123, CS1, HER2, AFP, or AFP p26) stimulates the CAR T cell to initiate intracellular signaling. In further embodiments, the binding of the CAR T cell to the target of interest stimulates the T cell to initiate intracellular signaling and produce cytokines. In further embodiments, the binding of the CAR T cell to the target of interest stimulates the T cell to initiate intracellular signaling, produce cytokines, and degranulate, leading to the cytotoxic effects on the cancer cell. In some embodiments, the CAR T cell proliferates in response to binding the target of interest. Advantageously, in some embodiments, the activity of the CAR T cell does not result in the T cell exhibiting a phenotype associated with T cell exhaustion. In some embodiments, the transmembrane domain of the CAR T cell comprises 41BB or CD28, and the cytoplasmic domain comprises an alpha, beta, or zeta chain of the T cell receptor.

In some embodiments, the administered CAR further comprises 2, 3, 4, 5, or more than 5, DD and/or other binding domains (e.g., scFv) that specifically bind the target of interest (e.g., BCMA, CD123, CS1, HER2, AFP, or AFP p26) expressed by the cancer cell. In additional embodiments, the administered CAR further comprises 2, 3, 4, 5, or more than 5, DD or other binding domains (e.g., scFv) that specifically binds a different target of interest expressed by the cancer cell. In additional embodiments, the administered CAR further comprises 2, 3, 4, 5, or more than 5, DD or other binding domains (e.g., scFv) that specifically binds a different target of interest expressed by a different cancer cell or a vascular endothelial cell.

In some embodiments, the administered immune cell further comprises a second CAR polypeptide having a DD or other binding domain (e.g., scFv) that specifically binds a second target of interest expressed by the cancer cell. In some embodiments, the administered immune cell further comprises a second CAR polypeptide having a DD or other binding domain (e.g., scFv) that specifically binds a second target of interest expressed by a different cancer cell or a vascular endothelial cell.

In some embodiments, the administration of the immune cells with a CAR is intravenous. In other embodiments, the immune cells with a CAR is administered through an intra-arterial, intramuscular, local, or other acceptable route for the given treatment scenario.

In some embodiments, the disclosure also provides methods of treating a subject having cancer, comprising, administering to the subject an immune cell comprising a chimeric antigen receptor (CAR), wherein the CAR comprises a target binding domain, wherein the target binding domain comprises a polypeptide having an amino acid sequence selected from the group consisting of SEQ ID NO: 11-305, and 306; SEQ ID NO: 307-739, and 740; SEQ ID NO: 741-874 and 886-895; SEQ ID NO: 896-909 and 910; or SEQ ID NO: 911-949, and 950; wherein the polypeptide specifically binds a target of interest (e.g., BCMA, CD123, CS1, HER2, AFP, or AFP p26) expressed by a cancer cell.

In additional embodiments, the disclosure provides a method of treating a subject having cancer, the method comprising intravenously administering to the subject an immune cell comprising a chimeric antigen receptor (CAR) expressed on a T cell, wherein the CAR comprises a target binding domain comprising a polypeptide having an amino acid sequence selected from the group consisting of SEQ ID NO: 11-305, and 306; SEQ ID NO: 307-739, and 740; SEQ ID NO: 741-874 and 886-895; SEQ ID NO: 896-909 and 910; or SEQ ID NO: 911-949, and 950; a transmembrane domain selected from 41BB and CD28, and an intracellular domain, wherein the intracellular domain comprises a signaling domain selected from an alpha, beta, or zeta chain of the T cell receptor, wherein, upon administration to a subject having cancer, the target binding domain specifically binds to the target of interest (e.g., BCMA, CD123, CS1, HER2, AFP, or AFP p26) expressed by a cancer cell, and wherein the binding of the target of interest induces the CAR T cell to generate cytotoxic signals that result in cytotoxic effects on the cancer cell. In some embodiments, the cytotoxic effects result from degranulation of the CAR T cells. Advantageously, in some embodiments, the activation and cytotoxic activity of the CAR T cells is not associated with the CAR T cells exhibiting a phenotype associated with T cell exhaustion. In some embodiments, the CAR optionally further comprises a second target binding domain comprising a second polypeptide having a different target than the target binding domain. In still further embodiments, additional targeting domains can optionally be included to enhance binding capacity to a marker, or impart binding specificity to other markers.

In some embodiments, the disclosure provides for the use of an immune cell comprising a chimeric antigen receptor (CAR) for the treatment of cancer, wherein the CAR comprises a target binding domain comprising an amino acid sequence selected from the group consisting of SEQ ID NO: 11-305, and 306; SEQ ID NO: 307-739, and 740; SEQ ID NO: 741-874 and 886-895; SEQ ID NO: 896-909 and 910; or SEQ ID NO: 911-949, and 950; a transmembrane domain selected from 41BB and CD28, and an intracellular domain, wherein the intracellular domain comprises a signaling domain selected from an alpha, beta, or zeta chain of the T cell receptor, wherein, upon administration to a subject having cancer, the target binding domain specifically binds to the target of interest (e.g., BCMA, CD123, CS1, HER2, AFP, or AFP p26) expressed by a cancer cell, and wherein the binding of the target of interest induces the immune cell to generate cytotoxic signals that result in cytotoxic effects on the cancer cell. In different embodiments, the immune cells can be a T cell or a natural killer (NK) cell.

Cancers that can be treated include tumors that are not vascularized, or not yet substantially vascularized, as well as vascularized tumors. The cancers can comprise non-solid tumors (such as hematological tumors, for example, leukemias and lymphomas) or can comprise solid tumors. Types of cancers to be treated with the DDpp include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included.

In some embodiments, the DDpp described herein are useful for treating a patient having hematological cancers. Examples of hematological (or hematogenous) cancers include leukemias, including acute leukemias (such as acute lymphocytic leukemia, acute myelocytic leukemia, acute myelogenous leukemia and myeloblasts, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia. In some embodiments, the hematological cancer is multiple myeloma.

Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pineaioma, hemangioblastoma, acoustic neuroma, oligodendroglioma, menangioma, neuroblastoma, retinoblastoma and brain metastases). In some embodiments, the cancer is breast cancer or ovarian cancer.

In additional embodiments, the DDpp fusion protein binds (1) a target on a cell or tissue of interest (e.g., a tumor antigen on a tumor cell) and (2) a target on an effector cell, such as, a T cell receptor molecule. According to one embodiment, the binding of one or more targets by the DDpp fusion protein is used to direct an immune response to an infectious agent, cell, tissue, or other location of interest in a patient. For example, in some embodiments, the DDpp fusion protein specifically binds a target on the surface of an effector cell. Thus, in some embodiments, the DDpp fusion protein specifically binds a target on the surface of a T cell. In specific embodiments, the DDpp fusion protein specifically binds CD3. In other embodiments, the DDpp fusion protein specifically binds CD2. In a further embodiment, the DDpp fusion protein specifically binds the T cell receptor (TCR). According to additional embodiments, the DDpp fusion protein specifically binds a target on the surface of a Natural Killer Cell. Thus, in some embodiments, the DDpp fusion protein specifically binds a NKG2D (Natural Killer Group 2D) receptor. In additional embodiments, the DDpp fusion protein specifically binds CD16 (i.e., Fc gamma RIII) CD64 (i.e., Fc gamma RI), or CD32 (i.e., Fc gamma RII).

In one embodiment, a DDpp fusion protein binds a target on a leukocyte and a tumor antigen on a tumor cell. In some embodiments, the DDpp fusion protein binds NKG2D. In a further embodiment, a DDpp fusion protein binds NKG2D and a target selected from ErbB2, EGFR, IGF1R, CD19, CD20, CD80 and EPCAM. In one embodiment, a DDpp fusion protein binds CD3. In particular embodiments, the DDpp specifically binds CD3 epsilon. In one embodiment, a DDpp fusion protein binds CD4.

DDpp Drug Conjugates

In a further embodiment a DDpp fusion protein may be linked to other organic or inorganic molecules or substrates through the use of chemically conjugation. In one embodiment, DDpp-drug conjugates are intended to facilitate the local delivery of cytotoxic agents through the targeting specificity of the DDpp. This combination of targeting specificity and cytotoxic agent, allows targeted delivery of the drug to tumors, and intracellular accumulation therein, where systemic administration of these unconjugated drug agents may result in unacceptable levels of toxicity to normal cells as well as the tumor cells sought to be eliminated (Baldwin et al., Lancet pages 603-605 (1986); Thorpe, "Antibody Carriers Of Cytotoxic agents In Cancer Therapy: A Review," in Monoclonal Antibodies '84: Biological And Clinical Applications, A. Pinchera et al., (ed.s), pp. 475-506 (1985)).

Cytotoxic agents include chemotherapeutic agents, growth inhibitory agents, toxins (e.g., an enzymatically active toxin of bacterial, fungal, plant, or animal origin, or fragments thereof), radioactive isotopes (i.e., a radioconjugate), etc. Chemotherapeutic agents useful in the generation of such immunoconjugates include, for example, methotrexate, adriamicin, doxorubicin, melphalan, mitomycin C, chlorambucil, daunorubicin or other intercalating agents. Chemotherapeutic agents useful in the generation of such immunoconjugates also include antitubulin drugs, such as auristatins, including monomethyl auristatin E (MMAE) and monomethyl auristatin F (MMAF). Enzymatically active toxins and fragments thereof that can be used according to the disclosed methods include diphtheria A chain, nonbinding active fragments of diphtheria toxin, exotoxin A chain, ricin A chain, abrin A chain, modeccin A chain, alpha-sarcin, Aleurites fordii proteins, dianthin proteins, Phytolaca americana proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In one embodiment, a DDpp (e.g., a DDpp fusion protein) is conjugated to a radioisotope. In a further embodiment, a DDpp is conjugated to an isotope selected from $^{90}$Y, $^{125}$I, $^{131}$I, $^{123}$I, $^{111}$In, $^{105}$Rh, $^{153}$Sm, $^{67}$Cu, $^{67}$Ga, $^{166}$Ho, $^{177}$Lu, $^{186}$Re and $^{188}$Re using anyone of a number of known chelators or direct labeling. In other embodiments, the DDpp is coupled to drugs, prodrugs or lymphokines such as interferon. Conjugates of the DDpp and cytotoxin can routinely be made using a variety of bifunctional protein-coupling agents such as N-succinimidyl-3-(2-pyridyidithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis(p-azidobenzoyl) hexanediamine), bis-diazonium derivatives (such as bis-(p-diazo-niumbenzoyl)-ethylenediamine), diisocyanates (such as tolyene 2,6-diisocyanate), and bis-active fluorine compounds (such as 1,5-difluoro-2,4-dinitrobenzene). In a specific embodiment, the toxin is conjugated to a DDpp fusion protein through an enzyme-cleavable linker system (e.g., such as that present in SGN-35). Conjugates of a DDpp and one or more small molecule toxins, such as a calicheamicin, maytansinoids, a trichothene, and CC1065, and the derivatives of these toxins that have toxin activity, can also be used.

In some embodiments, the cytotoxic agent is covalently attached to a DDpp by a linker. In some embodiments, the linker attaching the DDpp and the cytotoxic agent is cleavable by a protease.

Therapeutic Use as Cell Associated Receptor

In one embodiment, the disclosed DDpp-CARs are used for the purpose of redirecting transduced T cells to a tumor target defined by the binding specificity of the DDpp-CAR. In one embodiment, primary T cells are transduced with a lentiviral vector encoding a CAR that combines a DD target binding domain with a transmembrane domain and an intracellular domain of CD3-zeta, CD28, 41BB. The resultant population of transduced T cells may therefore elicit a DDpp-CAR-mediated T cell response. In some embodiments, T cells are genetically modified to express DDpp-CAR and the DDpp-CAR T cell is infused to a recipient in need thereof. In further embodiments, the infused cell is able to kill tumor cells in the recipient. Particularly advantageous properties of DDpp-CARs include one, several or all of the following benefits: (i) target-binding specificity, (ii) enhanced therapeutic efficacy, (iii) reduced off-target side effects, (iv) customizability for markers of a particular patient or patient population, (v) enhanced stability during production and processing, and (vi) ability to target one, two, or more specific targets to enhance target-directed therapy.

"Genetically modified cells", "redirected cells", "genetically engineered cells" or "modified cells" as used herein refer to cells that express a DDpp provided herein. In a particular embodiment, the genetically modified cells express a DDpp fusion protein such as a DDpp-CAR. In a further embodiment, the genetically modified cells express and display a DDpp-CAR on the cell surface.

"Disease targeted by genetically modified cells" as used herein encompasses the targeting of any cell involved in any manner in any disease by the genetically modified cells, irrespective of whether the genetically modified cells target diseased cells or healthy cells to effectuate a therapeutically beneficial result. The genetically modified cells include but are not limited to genetically modified T cells, NK cells, hematopoietic stem cells, pluripotent embryonic stem cells or embryonic stem cells. The genetically modified cells express the DDpp-CAR, which can target any of the antigens expressed on the surface of target cells.

In one embodiment, the DDpp portion of the DDpp-CAR is designed to treat a particular cancer. Cancers that can be treated include tumors that are not vascularized, or not yet substantially vascularized, as well as vascularized tumors. The cancers can comprise non-solid tumors (such as hematological tumors, for example, leukemias and lymphomas) or can comprise solid tumors. Types of cancers to be treated with the DDpp-CARs include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included.

Examples of hematological (or hematogenous) cancers include leukemias, including acute leukemias (such as acute lymphocytic leukemia, acute myelocytic leukemia, acute myelogenous leukemia and myeloblasts, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia.

Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pineaioma, hemangioblastoma, acoustic neuroma, oligodendroglioma, menangioma, neuroblastoma, retinoblastoma and brain metastases).

In one embodiment, cancers and disorders can be treated using cell expressing DDpp-CAR that target BCMA, CD123, CS1, HER2, AFP, or AFP p26. In one specific embodiment, the DD-CAR can be designed to target CD22 to treat B cell lymphoma. In another embodiment the cell expressing DDpp-CAR contain a DDpp designed to target CD19 can be used to treat cancers and disorders including but are not limited to pre-B ALL (pediatric indication), adult ALL, mantle cell lymphoma, diffuse large B-cell lymphoma, salvage post allogenic bone marrow transplantation, and the like. In another embodiment the cell expressing DDpp-CAR contain a DDpp designed to target CS1 can be used to treat multiple myeloma. In another embodiment the cell expressing DDpp-CAR contain a DDpp designed to target BCMA can be used to treat multiple myeloma. In another embodiment the cell expressing DDpp-CAR contain a DDpp designed to target CS1 and a DDpp designed to target BCMA can be used to treat multiple myeloma. In another embodiment the cell expressing DDpp-CAR contain a DDpp designed to target HER2 can be used to treat breast cancer or ovarian cancer.

"B cell associated diseases" as used herein include B cell immunodeficiencies, autoimmune diseases and/or excessive/uncontrolled cell proliferation associated with B cells (including lymphomas and/or leukemias). Examples of such diseases, wherein DDpp-CAR may be used for therapeutic approaches include but are not limited to systemic lupus erythematosus (SLE), diabetes, rheumatoid arthritis (RA), reactive arthritis, multiple sclerosis (MS), pemphigus vulgaris, celiac disease, Crohn's disease, inflammatory bowel disease, ulcerative colitis, autoimmune thyroid disease, X-linked agammaglobulinaemis, pre-B acute lymphoblastic leukemia, systemic lupus erythematosus, common variable immunodeficiency, chronic lymphocytic leukemia, diseases associated with selective IgA deficiency and/or IgG subclass deficiency, B lineage lymphomas (Hodgkin's lymphoma and/or non-Hodgkin's lymphoma), immunodeficiency with thymoma, transient hypogammaglobulinemia and/or hyper IgM syndrome, as well as virally-mediated B cell diseases such as EBV mediated lymphoproliferative disease, and chronic infections in which B cells participate in the pathophysiology.

In a preferred embodiment, the DDpp-CAR is expressed in a T cell and provides a method for treating or preventing cancer, comprising the administration of host cells expressing DDpp-CAR to a cancer patient in which the cancer cell expresses a tumor antigen on its surface, and wherein the DDpp specifically binds the target antigen. Exemplary target antigens that the DDpp and DDpp-CAR bind include, but are not limited to, BCMA, CS1, HER2, and CD123.

The DDpp-CAR-modified T cells can also serve as a type of vaccine for ex vivo immunization and/or in vivo therapy in a mammal Preferably, the mammal is a human.

The DDpp-CAR-modified T cells provided herein can be administered either alone, or as a pharmaceutical composition in combination with diluents and/or with other components such as chemotherapeutics, antibodies, cytokines or cell populations. Compositions provided herein are preferably formulated for intravenous administration that can be administered one or more times.

"Antigen loss escape variants" as used herein refer to cells which exhibit reduced or loss of expression of the target antigen, which antigens are targeted by a CAR provided herein.

Various embodiments, of the disclosure will now be illustrated through the description of experiments conducted in accordance therewith. The examples that follow are provided to facilitate the practice of the disclosed embodiments, and are not to be construed as limiting in any way the remainder of the disclosure. In the examples, reference is made to the appended figures.

EXAMPLES

Example 1. Isolation and Characterization of DDpp that Bind Exemplary Targets of Interest A DDpp library prepared as described in Intl. Appl. Publ. Nos. WO2016164305 and WO 2016164369, was screened for phage the bind BCMA, CD123, AFP, or AFP p26 through multiple rounds of selection. The contents of each of Intl. Appl. Publ. Nos. WO2016164305 and WO 2016164369, is herein incorporated by reference in its entirety).

Individual colonies containing phagemid from BCMA panning output were picked and phage were rescued in 96-well format using VCSM13 helper phage following standard protocols. To assay target binding by ELISA, 96-well plates were coated with 1.3 microg/ml goat anti-human IgG1-Fc antibody followed by incubation with 5 nM of recombinant human target (BCMA-Fc, CD123-Fc, AFP, or AFP123) or IgG1-Fc. 50 microl of rescued phage diluted 5× in ELISA blocking buffer was then added to each well. Binding was detected using an HRP-conjugated anti-M13 antibody and the ELISA ratio for each sequence is reported as the absorbance at 450 nm for target (i.e., BCMA-Fc, CD123-Fc, AFP, or AFP123) divided by that for IgG1-Fc averaged across all screened wells containing that clone.

Example 2. DDpp Fusion Proteins

To assess the modular nature of DDpp as a binding element, the DDpp CD137-binder, bb10 (SEQ ID NO: 876), was reformatted as a fusion to either the N or C terminus of the heavy chain of an antibody derived from the sequence of the RSV-specific monoclonal antibody palivizumab (SYNAGIS®). Bi-specific antibodies, SYN-bb10 and bb10-SYN exhibit binding to both CD137 and RSV (FIGS. 1A-1B; closed squares are bb10-SYN, closed circles are SYN-bb10)), demonstrating that a novel binding activity was imparted to the parental D domain sequence and the functionality of DDpp is retained as both N and C-terminal fusion. In contrast, fusions between a target-less alpha-helical protein scaffold (SEQ ID NO: 1) and SYN (DD-SYN for N-terminal fusion, open circles; SYN-DD for C-terminal fusion, open squares) showed binding only to RSV, but no binding to CD137.

Figure 1B:
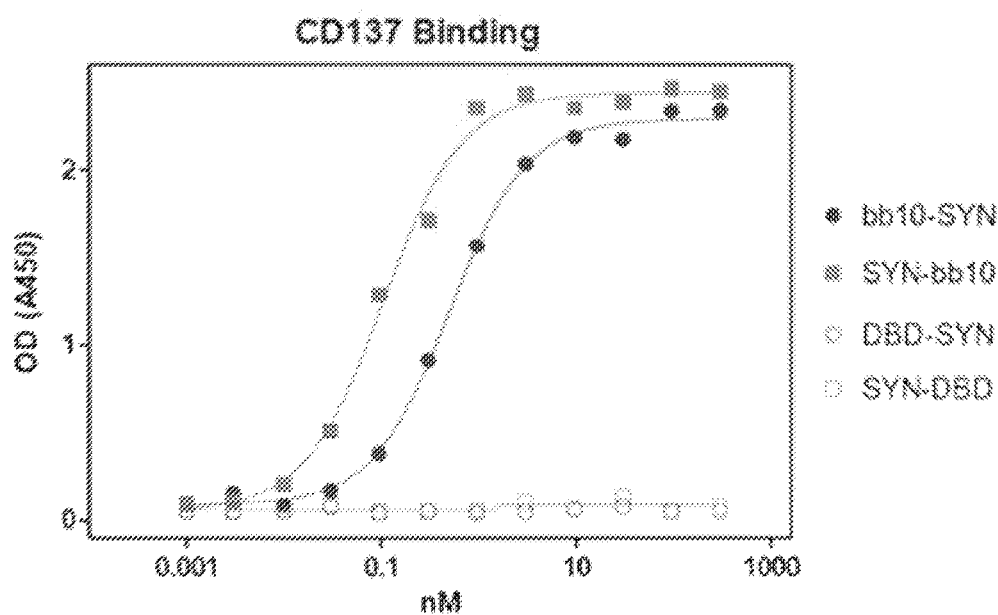
Figure 2A:
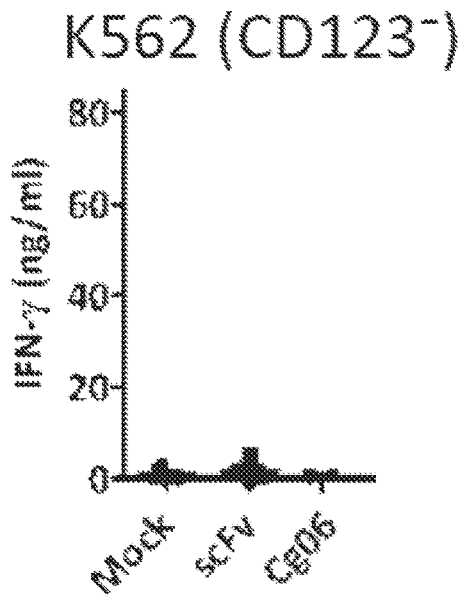
Figure 2B:
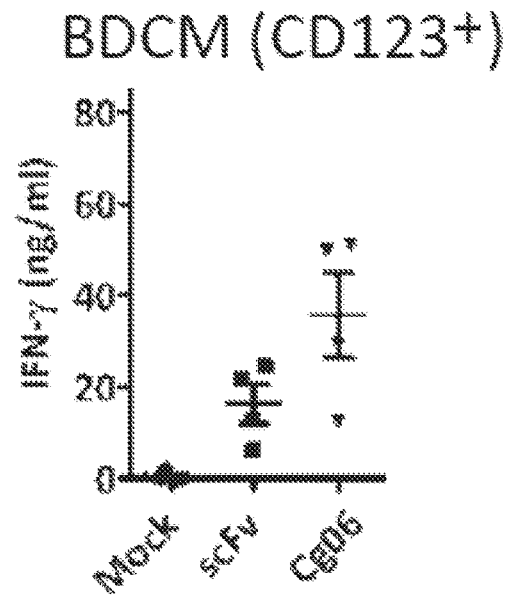
Figure 2C:
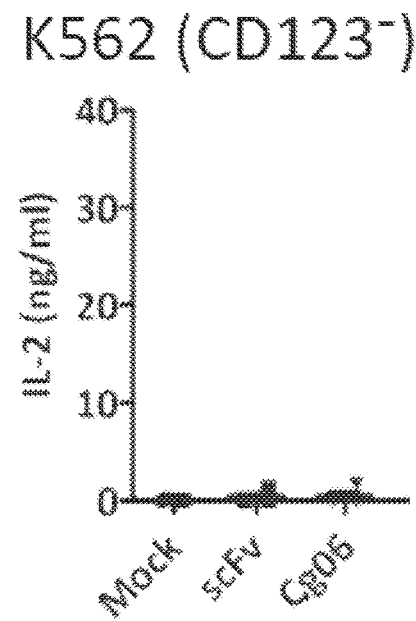
Figure 2D:
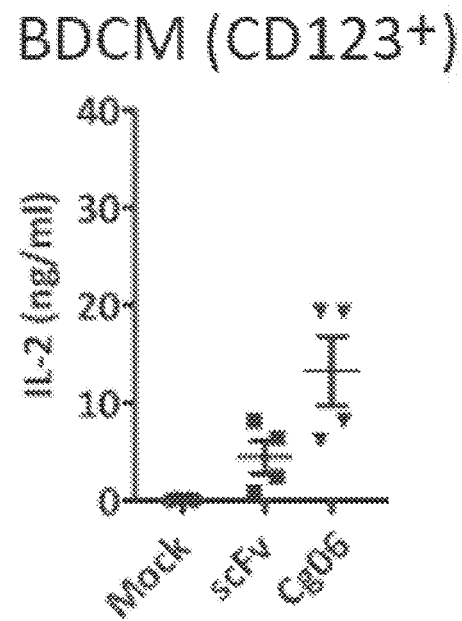
Figure 3A:
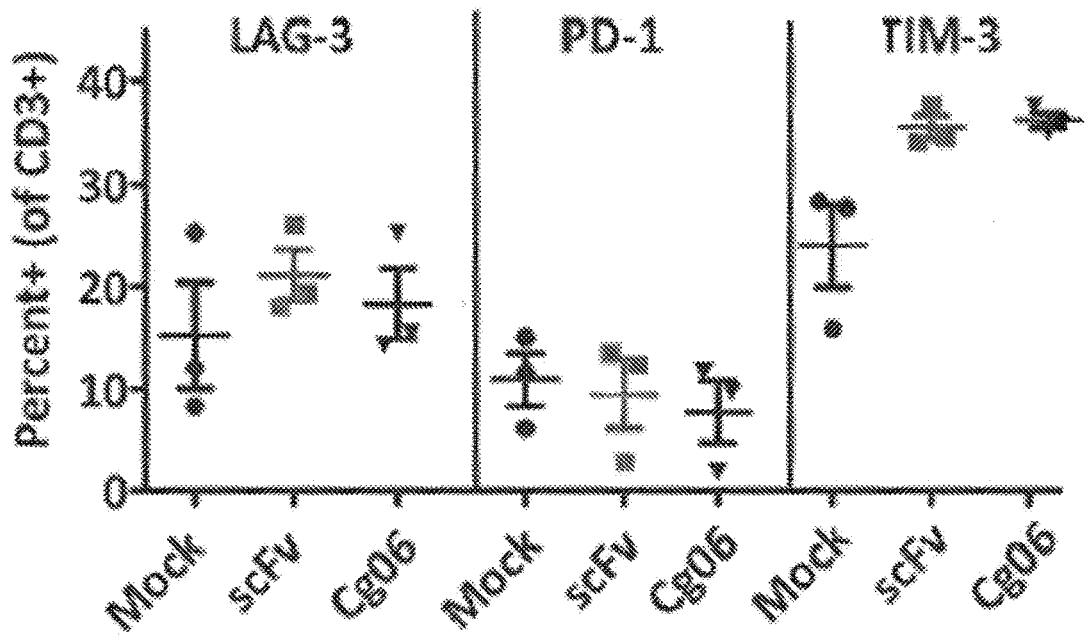
FIGS. 3A-3B. T cells expressing DDpp-CARs do not undergo excessive exhaustion to a greater degree than scFv.
Figure 3B:
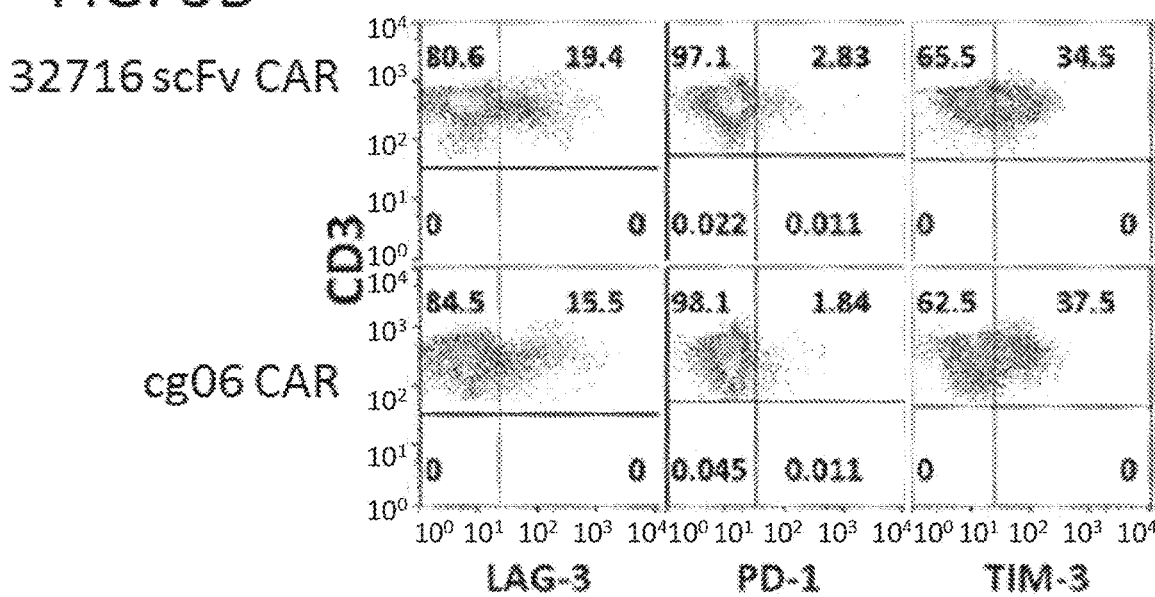

Binding of DDpp, bb10 to CD137 directly bound to plastic was demonstrated using ELISA (FIGS. 1A-1B). Binding of DDpp bb10 to CD137 as part of a cell membrane was also observed in situ, using FACS (data not shown)

Example 3. DDpp-CARs Expressed in Human T Cells Produce Cytokines on Target Binding The ability of target: DDpp-CAR-expressing T cell engagement to result induce cytokine secretion was assessed by 293T cells were transiently transfecting 293T cells with 3rd generation lentiviral packaging vectors (pRSV-REV, pMDLg/pRRE, and pMD2.G) with pELNS vectors encoding DDpp-CARs using LIPOFECTAMINE® 3000. Six hours post-transfection the media was changed, then lentivirus containing media was collected at 30 and 54 hours post-transfection, pooled, then centrifuged to remove cell debris. Lentivirus was then aliquoted and stored at −80° C. until used for viral transduction. Transduction of human T cells with CAR lentivirus was performed using total human PBMCs, activated with αCD3/CD28 T cell activation beads in culture media supplemented with 40 U/ml of IL2. After 24 hours, $2\times10^6$ PBMCs were plated per well in a 6-well tissue culture plate with 1 ml of culture media and 3 ml of lentivirus containing media supplemented with 40 U/ml of IL2 and protamine sulfate. Plates were then centrifuged for 2 hours at 1000×g at 32° C. and then incubated overnight 37° C. The following day the lentivirus transduction procedure was repeated with fresh culture media and lentivirus-containing media. 72 hours after the initial cell activation, T cell activation beads were removed, then T cells were cultured for expansion at ~$0.25$-$0.5\times10^6$ T cells/ml in fresh media supplemented with 100 U/ml of IL2. Every 2-3 days T cells were supplemented with additional T cell media and IL2, until they were used for the cytokine assays (described below) 7-10 days after the initial activation.

Cytokine production in response to target antigen expression (CD123) was assessed by culturing 25,000 transduced T cells (7 days post-activation) with 25,000 non-target (K562, CD123) or target (BDCM, $CD123^+$) tumor cells per well in 96-well plates. After 24 hours culture supernatants were collected and cytokine production was assessed by ELISA. Culture supernatants were diluted 1:5 prior to ELISA. Similarly, cytokine production in response to PDL1 target antigen expression was assessed by culturing 25,000 transduced T cells (7-days post activation) with 25,000 non-target (K562, PDL1) or target (SUDHL1, $PDL1^+$) tumor cells per well in 96-well plates. After 24 hours culture supernatants were collected and cytokine production was assessed by ELISA. Culture supernatants were diluted 1:5 prior to ELISA.

FIG. 2A and FIG. 2B demonstrate that T cells expressing CD123 binding DDpp-CARs produce interferon gamma (IFNγ) following stimulation with $CD123^+$ BDCM cells, but not the $CD123^-$ cell line K562. FIG. 2C and FIG. 2D demonstrates that T cells expressing CD123 binding DDpp-CARs produce interleukin 2 (IL2) following stimulation with $CD123^+$ BDCM cells, but not the $CD123^-$ cell line K562. Similarly, FIGS. 2E and 2F demonstrate that T cells expressing PDL1 binding DDpp-CARs produce interferon gamma (IFNγ) and IL2 respectively following stimulation with $PDL1^+$ SUDHL1 cells but not the PDL1 cell line K562.

Example 4. DDpp-CAR Transduced T Cells do not Display Phenotypes Associated with T Cell Exhaustion To assess potential antigen-independent exhaustion in T cells expressing DDpp-CARs, transduced T cells (day 10 post-activation) were stained with antibodies against CD3 and markers of T cell exhaustion (LAG3, PD1, and TIM3). FIG. 3A summarizes data from individual experiments across several T cell donors. The data demonstrate that expression of the exhaustion markers was not enhanced in CD123-binding DDpp-CAR T cells over that observed with the anti-CD123 CAR comprising the scFv (32176). FIG. 3B shows representative flow cytometry data of LAG3, PD1, and TIM3 expression in T cells transduced with either a scFv-containing CAR (top row) or a DDpp-CAR (in this particular experiment CD123 targeting cg06) 10 days after the initial activation of the T cells. The similarity of these data again demonstrate that DDpp-CAR T cells do not upregulate expression of exhaustion markers, which lends further support to their efficacy in cancer immunotherapy.

Example 5. DDpp-CAR Expressing T Cells Exhibit Target-Specific Degranulation and Tumor Cytotoxicity To assess degranulation of T cells expressing DDpp-CARs, $1\times10^5$ transduced T cells (day 9 post-activation) were cultured in T cell media for 4 hours in the presence of monensin and PE-conjugated CD107a/LAMP1. T cells were cultured alone (FIG. 4A) or in the presence of $2\times10^5$ non-target tumor cells (K562, which are CD123, FIG. 4B or target-expressing tumor cells (BDCM, $CD123^+$, FIG. 4C), then washed and stained for CD3 expression. T cell degranulation was then assessed by flow cytometry, first gating on the CD3+SSC-low cells (non-tumor), then the CD3+ CD107a+ cells. Symbols represent samples from individual experiments using multiple donors.

The production of CD107a (a marker of degranulation of the DDpp-CAR T cells) was equivalent to negative controls when CD123-targeting DDpp-CAR T cells were cultured alone. Limited CD107a expression when DDpp-CAR T cells were co-cultured with CD123 negative K562 tumor cells and significant CD107a expression was observed when CD123-targeting DDpp-CAR T cells were co-cultured with CD123 positive BDCM cells (data not shown). These data indicate that the T cells are activated, undergoing signaling, undergoing degranulation, and will result in tumor eradication. These data also provide further support for the target-dependent activation of DDpp-CAR expressing T cells.

The cytolytic activity of DDpp-CAR T cells was assessed using T cells prepared from two independent donors. Donor #1 (FIG. 5A-5B) DDpp-CAR T cells effectively kill the CD123 expressing tumor, BDCM, but show very little cytolytic activity on the CD123 negative tumor, K562. Similar results were observed with Donor #2 (FIGS. 5C and 5D).

Example 6. Bi-Specific DDpp

As discussed above, DDpp can be monovalent or multivalent and/or multispecific. To evaluate the ability of multispecific DDppCAR T cells to elicit an immune response, bi-specific DDpp-CARs were expressed on Jurkat cells and intracellular signaling in response to tumor cells expressing one or both targets was measured. Two bi-specific DDpp-CARs were constructed that differed in the fusion order of the binding domains. CG06-pb04 has the pb04 domain fused to the CD8a transmembrane region while the pb04-cg06 has the cgo6 domain fused to the CD8a transmembrane region. Both constructs utilized a GS linker between the target-binding domains.

Figure 5A:
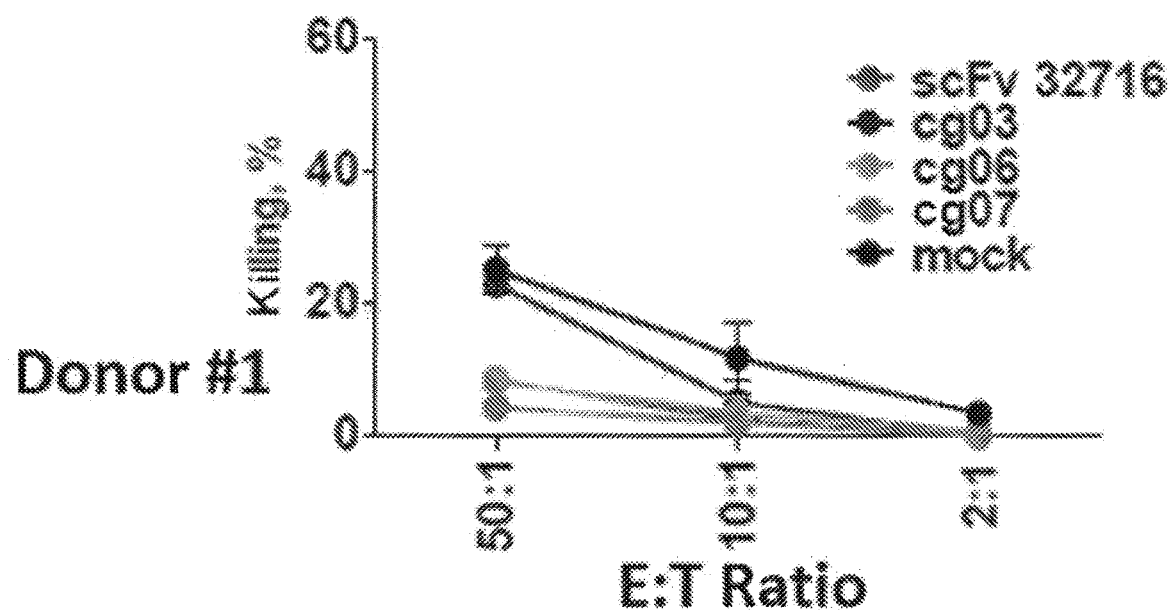
FIGS. 5A-5D. T cells expressing DDpp-CARs mediate target-specific tumor cytotoxicity.
Figure 5B:
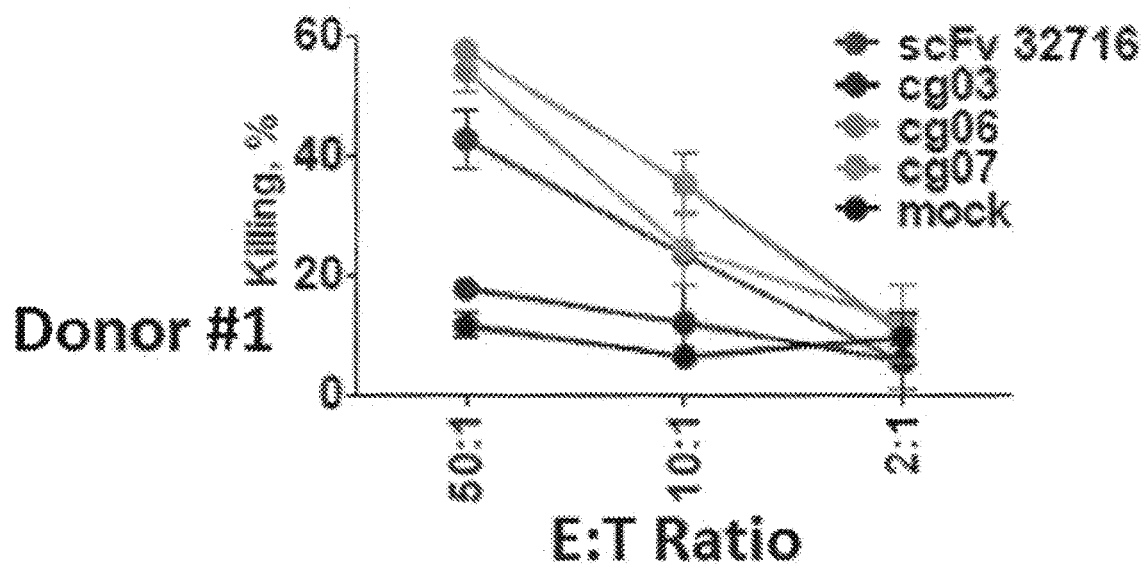
Figure 5C:
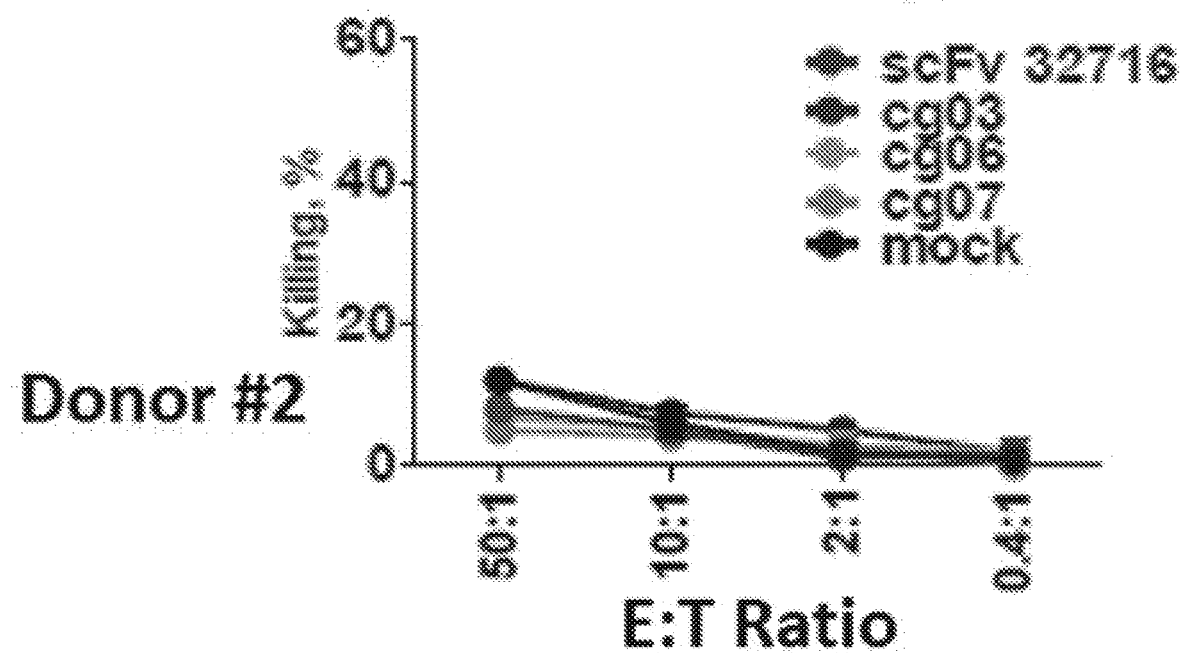
Figure 5D:
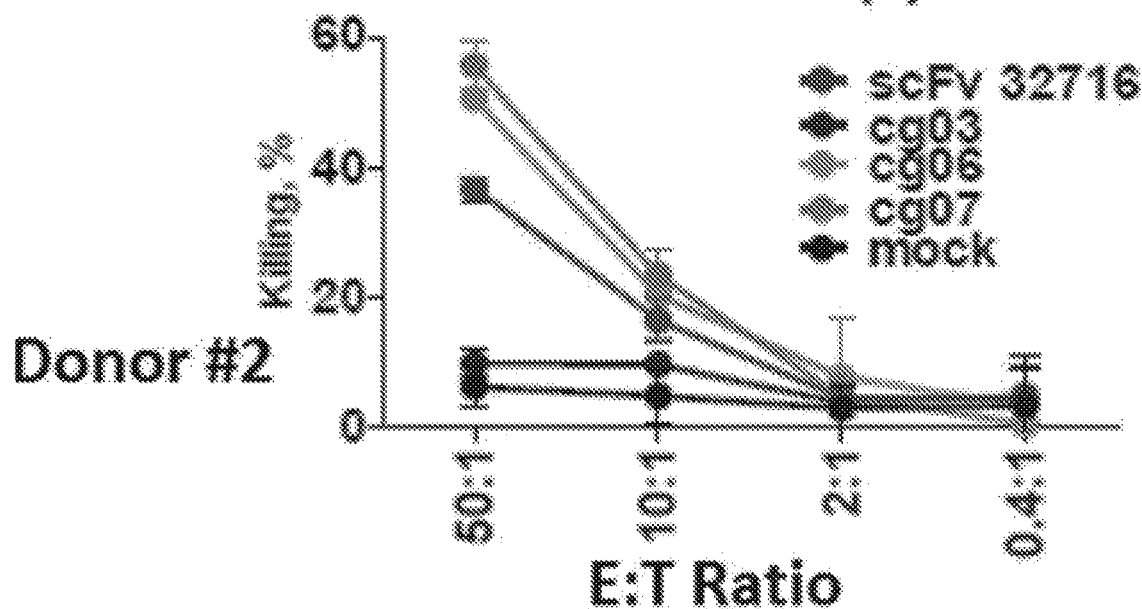

FIG. 6A demonstrates that DDpp-CARs comprising cg06 only, pb04 only (FIG. 6B), cg06-pb04, (FIG. 5C), and pb04-cg06 (FIG. 5D) can be transduced and expressed in the Jurkat NFAT reporter cell line as assessed by anti-FLAG mAb binding to the CARs. The ability of the mono-specific and bi-specific CARs to activate the NFAT pathway was assessed by co-culturing the various CARs with tumor cells with different level of CD123 and/or PDL1 expression. Cells were co-cultured with target cells for 6 hours. NFAT mediated signaling was measured through the addition to the cells of luciferase assay reagent (Promega) and quantitation of relative luminescence units (RLU) as a measure of induced intracellular signaling.

FIG. 6E depicts the results of this experiment. The leftmost group of bars and the histogram show the relative kill effect of the cg06 DDpp against various cell types. Signaling response after co-culture with highly CD123+ BDCM was the greatest with this DDpp-CAR. The next group to the right depicts data showing intracellular signaling after co-culture of the pb04 DDpp against the same cell types. Signaling was highest in BDCM, followed by SUHDL1, and H460 (these are the highest expressing cell lines for CD123 and PDL1 (data not shown)). The next group to the right depicts data showing intracellular signaling of a bi-specific cg06-pb04 DDpp (cg06 more distal to the T cell membrane as compared to pb04). Finally, the rightmost group shows intracellular signaling from a second bi-specific DBPpp (pb04-cg06 DDpp, where pb04 is more distal to the T cell membrane as compared to cg06). These two groups indicate that bi-specific DDpp-CARs do function to promote intracellular signaling. In accordance with embodiments, bi-specific DDpp-CARs show enhanced activity (the magnitude of intracellular signaling in the pb04-cg06 group with BDCM cells is greater than can be accounted for by just the pb04 DDpp alone). Thus in some embodiments, DDpp-CARs comprising two DDpps can cooperate to enhance T cell function. In some embodiments, there is a synergy between the various DDpp used in a bispecific (or other multimeric) DDpp-CAR.

Example 7. Use of Dual Binding Domain Adapters to Enhance CAR Signalling 50,000 reporter cells previously transduced with an AFP (p26 domain)-binding CAR (af03) (SEQ ID NO: 961) were cultured for 5 hours in the presence of the CD123-specific Cg06-adaptor (Cg06-p26, SEQ ID NO: 953) or the Cg06-dual adaptor protein (Cg06-p26-Cg06, SEQ ID NO: 956) in the presence of 50,000 CD123+ MOLM13 or CD123-deficient MOLM13 cells, then assessed for luciferase activity. CD123 deficient cells were generated using CRISPR/Cas9 genetic engineering technology (FIG. 7A). Similarly, 50,000 reporter cells previously transduced with an AFP (p26 domain)-binding CAR (af03) (SEQ ID NO: 961) were cultured for 5 hours in the presence of the BCMA-specific Bc40-adaptor (Bc40-p26, SEQ ID NO: 954) or the Bc40-dual adaptor protein (Bc40-p26-Bc40, SEQ ID NO: 957) in the presence or absence of 50,000 BCMA+ U266 cells, then assessed for luciferase activity (FIG. 7B).

FIGS. 7A and 7B show that dual-binding (bi-valent) domain adaptor proteins drive enhanced signaling by CAR-expressing Jurkat cells over single-binding domain adaptor proteins.

Example 8. DDpp-Mediated Tumor Immunotherapy In Vivo

Figure 8:
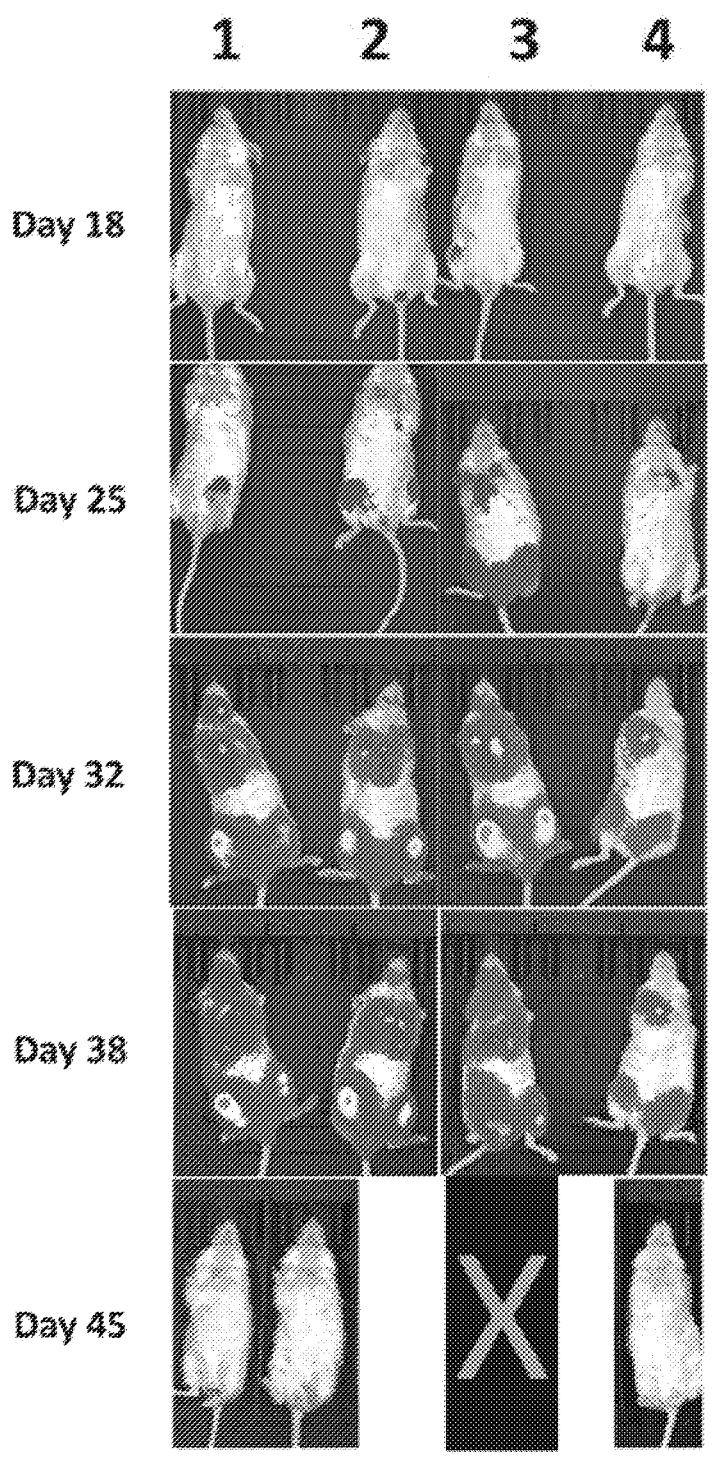
FIG. 8. The BCMA-targeting DDpp-CAR comprising the bc40 DDpp (SEQ-ID NO: 164) eradicates the BCMA-expressing tumor, U226 in a mouse model of B cell cancer.

To assess the in vivo anti-tumor activity of a DDpp CAR, T cells were transduced with bc40 DDpp CAR (BCMA targeting CAR). Bc40 is SEQ ID NO: 164. Transduced cells (5×10E6) were administered intravenously to NSG mice 34 days after mice received 10E7 cells of the BCMA expressing, luciferase/gfp labeled U226 tumor cells. As shown in FIG. 8, four mice received the U226 tumor on Day 0 which progressive grew through Day32. On Day 34, mouse #1, #2, and #4 received bc40-DDpp CAR T cells. Mouse #3 received no T cells. On Day 45, the U226 tumor was cleared in mice receiving CAR T cells while the mouse that did not receive T cells died of tumor burden.

All publications, patents, patent applications, internet sites, and accession numbers/database sequences (including both polynucleotide and polypeptide sequences) cited are herein incorporated by reference in their entirety for all purposes to the same extent as if each individual publication, patent, patent application, internet site, or accession number/database sequence were specifically and individually indicated to be so incorporated by reference.

It is contemplated that various combinations or subcombinations of the specific features and aspects disclosed above may be made and still fall within the embodiments, encompassed by the disclosure. Further, the disclosure of any particular feature, aspect, method, property, characteristic, quality, attribute, element, or the like in connection with an embodiment can be used in all other embodiments, set forth herein. Accordingly, it should be understood that various features and aspects of the disclosed embodiments, can be combined with or substituted for one another in order to form varying modes of the disclosed embodiments. Thus, it is intended that the scope of the embodiments, encompassed by the present disclosure should not be limited by the particular disclosed embodiments, described herein. Moreover, while the encompassed embodiments, are susceptible to various modifications, and alternative forms, specific examples thereof have been shown in the drawings and are herein described in detail. It should be understood, however, that the scope of the disclosure is not to be limited to the particular forms or methods disclosed, but to the contrary, the disclosure is to cover all modifications, equivalents, and alternatives falling within the spirit and scope of the various embodiments, described and the appended claims. Any methods disclosed herein need not be performed in the order recited. The methods disclosed herein include certain actions taken by a practitioner; however, they can also include any third-party instruction of those actions, either expressly or by implication. For example, actions such as "administering a T cell comprising a DDpp-CAR" include "instructing the administration of a T cell comprising a DDpp-CAR." In addition, where features or aspects of the disclosure are described in terms of Markush groups, those skilled in the art will recognize that the disclosure is also thereby described in terms of any individual member or subgroup of members of the Markush group.

The ranges disclosed herein also encompass any and all overlap, sub-ranges, and combinations thereof. Language such as "up to," "at least," "greater than," "less than," "between," and the like includes the number recited. Numbers preceded by a term such as "about" or "approximately" include the recited numbers. For example, "about 10 nanometers" includes "10 nanometers."

TABLE 2

Additional sequence disclosure:

| SEQ ID: | Target | Sequence |
|---|---|---|
| 1 | D Domain (targetless) | MGSWAEFKQRLAAIKTRLQALGGSEAELAAFEKEIAAFESELQAYKGKGNPEVEALRKEAAAIRDEL QAYRHN |
| 2 | MHC Epitope | LAAIKTRLQ |
| 3 | CD19 | LEKCFQTENPLECQDKGEEELQKYIQESQALAKRSCGLFQKLGEYYLQNAFLVAYTKKAPQLTSSEL MAITRKMAATAATCCQLSEDKLLACGEGAADIIIGHLCIRHEMTPVNPGVGQCCTSSYANRRPCFSS LVVDETYVPPAFSDDKFIFHKDLCQAQGVALQTMKQEFLINLVKQKPQITEEQLEAVIADFSGLLEK CCQGQEQEVCFAEEGQKLISKTRAALGV |
| 4 | GlySer | GGGGTGGGGS |
| 5 | GlySer | GGGGDGGGGS |
| 6 | a3D (Q19E) Targetless | MGSWAEFKQRLAAIKTRLEALGGSEAELAAFEKEIAAFESELQAYKGKGNPEVEALRKEAAAIRDEL QAYRHN |
| 7 | BCMA ECD | MLQMAGQCSQNEYFDSLLHACIPCQLRCSSNTPPLTCQRYCNASVTNSVKGTNA |
| 8 | CD123 ECD | TKEDPNPPITNLRMKAKAQQLTWDLLRNVTDIECVKDADYSMPAVNNSYCQFGAISLCEVTNYTVRV ANPPFSTWILFPENSGKPWAGAENLTCWIHDVDFLSCSWAVGPGAPADVQYDLYLNVANRRQQYECL HYKTDAQGTRIGCRFDDISRLSSGSQSSHILVRGRSAAFGIPCTDKFVVFSQIEILTPPNMTAKCNK THSFMHWKMRSHFNRKFRYELQIQKRMQPVITEQVRDRTSFQLLNPGTYTVQIRARERVYEFLSAWS TPQRFECDQEEGANTRAWR |
| 9 | AFP | RTLHRNEYGIASILDSYQCTAEISLADLATIFFAQFVQEATYKEVSKMVKDALTAIEKPTGDEQSSG CLENQLPAFLEELCHEKEILEKYGHSDCCSQSEEGRHNCFLAHKKPTPASIPLFQVPEPVTSCEAYE EDRETFMNKFIYEIARRHPFLYAPTILLWAARYDKIIPSCCKAENAVECFQTKAATVTKELRESSLL NQHACAVMKNFGTRTFQAITVTKLSQKFTKVNFTEIQKLVLDVAHVEHCCRGDVLDCLQDGEKIMS YICSQQDTLSNKITECCKLTTLERGQCIIHAENDEKPEGLSPNLNRFLGDRDFNQFSSGEKNIFLAS FVHEYSRRHPQLAVSVILRVAKGYQELLEKCFQTENPLECQDKGEEELQKYIQESQALAKRSCGLFQ KLGEYYLQNAFLVAYTKKAPQLTSSELMAITRKMAATAATCCQLSEDKLLACGEGAADIIIGHLCIR HEMTPVNPGVGQCCTSSYANRRPCFSSLVVDETYVPPAFSDDKFIFHKDLCQAQGVALQTMKQEFLI NLVKQKPQITEEQLEAVIADFSGLLEKCCQGQEQEVCFAEEGQKLISKTRAALGV |
| 10 | AFP p26 | LEKCFQTENPLECQDKGEEELQKYIQESQALAKRSCGLFQKLGEYYLQNAFLVAYTKKAPQLTSSEL MAITRKMAATAATCCQLSEDKLLACGEGAADIIIGHLCIRHEMTPVNPGVGQCCTSSYANRRPCFSS LVVDETYVPPAFSDDKFIFHKDLCQAQGVALQTMKQEFLINLVKQKPQITEEQLEAVIADFSGLLEK CCQGQEQEVCFAEECQKLISKTRAALCV |
| 968 | P26Q217P | LEKCFQTENPLECQDKGEEELQKYIQESQALAKRSCGLFQKLGEYYLQNAFLVAYTKKAP QLTSSELMAITRKMAATAATCCQLSEDKLLACGEGAADIIIGHLCIRHEMTPVNPGVGQC CTSSYANRRPCFSSLVVDETYVPPAFSDDKFIFHKDLCQAQGVALQTMKQEFLINLVKQK PQITEEQLEAVIADFSGLLEKCCQGQEQEVCFAEEGPKLISKTRAALGV |
| 969 | P26 (Q26-V229) | QESQALAKRSCGLFQKLGEYYLQNAFLVAYTKKAPQLTSSELMAITRKMAATAATCCQLS EDKLLACGEGAADIIIGHLCIRHEMTPVNPGVGQCCTSSYANRRPCFSSLVVDETYVPPA FSDDKFIFHKDLCQAQGVALQTMKQEFLINLVKQKPQITEEQLEAVIADFSGLLEKCCQG QEQEVCFAEEGQKLISKTRAALGV |
| 970 | P26 (Q26-V229) Q217P | QESQALAKRSCGLFQKLGEYYLQNAFLVAYTKKAPQLTSSELMAITRKMAATAATCCQLS EDKLLACGEGAADIIIGHLCIRHEMTPVNPGVGQCCTSSYANRRPCFSSLVVDETYVPPA FSDDKFIFHKDLCQAQGVALQTMKQEFLINLVKQKPQITEEQLEAVIADFSGLLEKCCQG QEQEVCFAEEGPKLISKTRAALGV |
| 971 | p26 (K23-V229) | KYIQESQALAKRSCGLFQKLGEYYLQNAFLVAYTKKAPQLTSSELMAITRKMAATAATCC QLSEDKLLACGEGAADIIIGHLCIRHEMTPVNPGVGQCCTSSYANRRPCFSSLVVDETYV PPAFSDDKFIFHKDLCQAQGVALQTMKQEFLINLVKQKPQITEEQLEAVIADFSGLLEKC CQGQEQEVCFAEEGQKLISKTRAALGV |
| 972 | p26 (K23-V229) Q217P | KYIQESQALAKRSCGLFQKLGEYYLQNAFLVAYTKKAPQLTSSELMAITRKMAATAATCC QLSEDKLLACGEGAADIIIGHLCIRHEMTPVNPGVGQCCTSSYANRRPCFSSLVVDETYV PPAFSDDKFIFHKDLCQAQGVALQTMKQEFLINLVKQKPQITEEQLEAVIADFSGLLEKC CQGQEQEVCFAEEGPKLISKTRAALGV |
| 973 | p26 (G17-V229) | GEEELQKYIQESQALAKRSCGLFQKLGEYYLQNAFLVAYTKKAPQLTSSELMAITRKMAA TAATCCQLSEDKLLACGEGAADIIIGHLCIRHEMTPVNPGVGQCCTSSYANRRPCFSSLV VDETYVPPAFSDDKFIFHKDLCQAQGVALQTMKQEFLINLVKQKPQITEEQLEAVIADFS GLLEKCCQGQEQEVCFAEEGQKLISKTRAALGV |
| 974 | p26 (G17-V229) Q217P | GEEELQKYIQESQALAKRSCGLFQKLGEYYLQNAFLVAYTKKAPQLTSSELMAITRKMAA TAATCCQLSEDKLLACGEGAADIIIGHLCIRHEMTPVNPGVGQCCTSSYANRRPCFSSLV VDETYVPPAFSDDKFIFHKDLCQAQGVALQTMKQEFLINLVKQKPQITEEQLEAVIADFS GLLEKCCQGQEQEVCFAEEGPKLISKTRAALGV |

TABLE 2-continued

Additional sequence disclosure:

| SEQ ID: | Target | Sequence |
|---|---|---|
| 963 | CD22 mature ECD | DSSKWVFEHPETLYAWEGACVWIPCTYRALDGDLESFILFHNPEYNKNTSKFDGTRLYESTKDGKVP SEQKRVQFLGDKNKNCTLSIHPVHLNDSGQLGLRMESKTEKWMERIHLNVSERPFPPHIQLPPEIQE SQEVTLTCLLNFSCYGYPIQLQWLLEGVPMRQAAVTSTSLTIKSVFTRSELKFSPQWSHHGKIVTCQ LQDADGKFLSNDTVQLNVKHTPKLEIKVTPSDAIVREGDSVTMTCEVSSSNPEYTTVSWLKDGTSLK KQNTFTLNLREVTKDQSGKYCCQVSNDVGPGRSEEVFLQVQYAPEPSTVQILHSPAVEGSQVEFLCM SLANPLPTNYTWYHNGKEMQGRTEEKVHIPKILPWHAGTYSCVAENILGTGQRGPGAELDVQYPPKK VTTVIQNPMPIREGDTVTLSCNYNSSNPSVTRYEWKPHGAWEEPSLGVLKIQNVGWDNTTIACAACN SWCSWASPVALNVQYAPRDVRVRKIKPLSEIHSGNSVSLQCDFSSSHPKEVQFFWEKNGRLLGKESQ LNFDSISPEDAGSYSCWVNNSIGQTASKAWTLEVLYAPRRLVSMSPGDQVMEGKSATLTCESDANP PVSHYTWFDWNNQSLPYHSQKLRLEPVKVQHSGAYWCQGTNSVGKGRSPLSTLTVYYSPETIGRR |
| 965 | CS1 mature ECD | SGPVKELVGSVGGAVTFPLKSKVKQVDSIVWTFNTTPLVTIQPEGGTIIVTQNRNRERVDFPDGGYS LKLSKLKKNDSGIYYVGIYSSSLQQPSTQEYVLHVYEHLSKPKVTMGLQSNKNGTCVTNLTCCMEHG EEDVIYTWKALGQAANESHNGSILPISWRWGESDMTFICVARNPVSRNFSSPILARKLCEGAADDPD SSM |
| 967 | HER2 mature ECD | TQVCTGTDMKLRLPASPETHLDMLRHLYQGCQVVQGNLELTYLPTNASLSFLQDIQEVQGYVLIAHN QVRQVPLQRLRIVRGTQLFEDNYALAVLDNGDPLNNTTPVTGASPGGLRELQLRSLTEILKGGVLIQ RNPQLCYQDTILWKDIFHKNNQLALTLIDTNRSRACHPCSPMCKGSRCWGESSEDCQSLTRTVCAGG CARCKGPLPTDCCHEQCAAGCTGPKHSDCLACLHFNHSGICELHCPALVTYNTDTFESMPNPEGRYT FGASCVTACPYNYLSTDVGSCTLVCPLHNQEVTAEDGTQRCEKCSKPCARVCYGLGMEHLREVRAVT SANIQEFAGCKKIFGSLAFLPESFDGDPASNTAPLQPEQLQVFETLEEITGYLYISAWPDSLPDLSV FQNLQVIRGRILHNGAYSLTLQGLGISWLGLRSLRELGSGLALIHHNTHLCFVHTVPWDQLFRNPHQ ALLHTANRPEDECVGEGLACHQLCARGHCWGPGPTQCVNCSQFLRGQECVEECRVLQGLPREYVNAR HCLPCHPECQPQNGSVTCFGPEADQCVACARYKDPPFCVARCPSGVKPDLSYMPIWKFPDEEGACQP CPINCTHSCVDLDDKGCPAEQRASPLT |

TABLE 3

Exemplary Adapters

| SEQ ID NO: | Adapter Design | Adapter Sequence |
|---|---|---|
| 951 | CD123(cg06)-BCMA-His tag | DEMGSWDEFGRRLYAIEWRLYALGGSEAELAAFEKEIAAFESE LQAYKGKGNPEVEKLREIAAVIRSNLQAYRHNGGGGSGGGGSG GGGGSGMLQMAGQCSQNEYFDSLLHACIPCQLRCSSNTPPLTCQ RYCNASVTNSVKGTNAGGGGSGGGGSGGGGSHHHHHHHHHH |
| 952 | α3D-BCMA-His tag | DEGGGGSMGSWAEFKQRLAAIKTRLQALGGSEAELAAFEKEIAAF ESELQAYKGKGNPEVEALRKEAAAIRDELQAYRHNGGGGSGGGGS GGGGSGMLQMAGQCSQNEYFDSLLHACIPCQLRCSSNTPPLTCQR YCNASVTNSVKGTNAGGGGSGGGGSGGGGSHHHHHHHHHH |
| 953 | HIS tag-CD123(cg06)-p26 | DEHHHHHHHHHHKLENLYFQGGGGGSMGSWDEFGRRLYAIEWRLY ALGGSEAELAAFEKEIAAFESELQAYKGKGNPEVEKLREIAAVIR SNLQAYRHNGGGGSGGGGSGGGGSLEKCFQTENPLECQDKGEEEL QKYIQESQALAKRSCGLFQKLGEYYLQNAFLVAYTKKAPQLTSSE LMAITRKMAATAATCCQLSEDKLLACGEGAADIIIGHLCIRHEMT PVNPGVGQCCTSSYANRRPCFSSLVVDETYVPPAFSDDKFIFHKD LCQAQGVALQTMKQEFLINLVKQKPQITEEQLEAVIADFSGLLEK CCQGQEQEVCFAEEGQKLISKTRAALGV |
| 954 | HIS tag-BCMA(bc40)-p26 | DEHHHHHHHHHHKLENLYFQGGGGGSMGSWSEFWVRLGAIRERLD ALGGSEAELAAFEKEIAAFESELQAYKGKGNPEVEKLRYTAATIR RFLQAYRHNGGGGSGGGGSGGGGSLEKCFQTENPLECQDKGEEEL QKYIQESQALAKRSCGLFQKLGEYYLQNAFLVAYTKKAPQLTSSE LMAITRKMAATAATCCQLSEDKLLACGEGAADIIIGHLCIRHEMT PVNPGVGQCCTSSYANRRPCFSSLVVDETYVPPAFSDDKFIFHKD LCQAQGVALQTMKQEFLINLVKQKPQITEEQLEAVIADFSGLLEK CCQGQEQEVCFAEEGQKLISKTRAALGV |
| 955 | HIS tag-α3D(Q19E)-p26 | DEHHHHHHHHHHKLENLYFQGGGGGSMGSWAEFKQRLAAIKTRLE ALGGSEAELAAFEKEIAAFESELQAYKGKGNPEVEALRKEAAAIR DELQAYRHNGGGGSGGGGSGGGGSLEKCFQTENPLECQDKGEEEL QKYIQESQALAKRSCGLFQKLGEYYLQNAFLVAYTKKAPQLTSSE LMAITRKMAATAATCCQLSEDKLLACGEGAADIIIGHLCIRHEMT PVNPGVGQCCTSSYANRRPCFSSLVVDETYVPPAFSDDKFIFHKD LCQAQGVALQTMKQEFLINLVKQKPQITEEQLEAVIADFSGLLEK CCQGQEQEVCFAEEGQKLISKTRAALGV |

TABLE 3-continued

Exemplary Adapters

| SEQ ID NO: | Adapter Design | Adapter Sequence |
|---|---|---|
| 956 | CD123(cg06-210)-p26-CD123 (cg06-210)-HIS tag | DEGGGGSMGSWDEFGRRLYAIEWQLYALGGTEAELAAFEKEIAAF ESELQAYKGKGNPEVEKLREIAAVIRENLQAYRHNGGGGSGGGGS GGGGSGLEKCFQTENPLECQDKGEEELQKYIQESQALAKRSCGLF QKLGEYYLQNAFLVAYTKKAPQLTSSELMAITRKMAATAATCCQL SEDKLLACGEGAADIIIGHLCIRHEMTPVNPGVGQCCTSSYANRR PCFSSLVVDETYVPPAFSDDKFIFHKDLCQAQGVALQTMKQEFLI NLVKQKPQITEEQLEAVIADFSGLLEKCCQGQEQEVCFAEEGQKL ISKTRAALGVGGGGSGGGGSGGGGSMGSWDEFGRRLYAIEWQLYA LGGTEAELAAFEKEIAAFESELQAYKGKGNPEVEKLREIAAVIRE NLQAYRHNGGGGSGGGGSGGGGSHHHHHHHHHH |
| 957 | BCMA(bc40)-p26-BCMA(bc40)-HIS tag | DEGGGGSMGSWSEFWVRLGAIRERLDALGGSEAELAAFEKEIAAF ESELQAYKGKGNPEVEKLRYTAATIRRFLQAYRHNGGGGSGGGGS GGGGSGLEKCFQTENPLECQDKGEEELQKYIQESQALAKRSCGLF QKLGEYYLQNAFLVAYTKKAPQLTSSELMAITRKMAATAATCCQL SEDKLLACGEGAADIIIGHLCIRHEMTPVNPGVGQCCTSSYANRR PCFSSLVVDETYVPPAFSDDKFIFHKDLCQAQGVALQTMKQEFLI NLVKQKPQITEEQLEAVIADFSGLLEKCCQGQEQEVCFAEEGQKL ISKTRAALGVGGGGSGGGGSGGGGSMGSWSEFWVRLGAIRERLDA LGGSEAELAAFEKEIAAFESELQAYKGKGNPEVEKLRYTAATIRR FLQAYRHNGGGGSGGGGSGGGGSHHHHHHHHHH |

TABLE 4

Exemplary ADBD CAR Sequences

| SEQ ID NO: | CAR Design | CAR Sequence |
|---|---|---|
| 958 | CTsp-Flag- GSlinker-α3D(Q19E)- GSlinker-CD8H-TM-41BB-CD3ζ | MAFLWLLSCWALLGTTFGDYKDDDDKGGGGSGGGGSMGSWAEF KQRLAAIKTRLEALGGSEAELAAFEKEIAAFESELQAYKGKGN PEVEALRKEAAAIRDELQAYRHNGQAGSGTTTPAPRPPTPAPT IASQPLSLRPEACRPAAGGAVHTRGLDFACDIYIWAPLAGTCG VLLLSLVITLYCKRGRKKLLYIFKQPFMRPVQTTQEEDGCSCR FPEEEEGGCELRVKFSRSADAPAYKQGQNQLYNELNLGRREEY DVLDKRRGRDPEMGGKPRRKNPQEGLYNELQKDKMAEAYSEIG MKGERRRGKGHDGLYQGLSTATKDTYDALHMQALPPR |
| 959 | CTsp-Flag- GSlinker-cg06- GSlinker-CD8H-TM-41BB-CD3ζ | MAFLWLLSCWALLGTTFGDYKDDDDKGGGGSGGGGSMGSWDEF GRRLYAIEWRLYALGGSEAELAAFEKEIAAFESELQAYKGKGN PEVEKLREIAAVIRSNLQAYRHNGGGGSGGGGSGTTTPAPRPP TPAPTIASQPLSLRPEACRPAAGGAVHTRGLDFACDIYIWAPL AGTCGVLLLSLVITLYCKRGRKKLLYIFKQPFMRPVQTTQEED GCSCRFPEEEEGGCELRVKFSRSADAPAYKQGQNQLYNELNLG RREEYDVLDKRRGRDPEMGGKPRRKNPQEGLYNELQKDKMAEA YSEIGMKGERRRGKGHDGLYQGLSTATKDTYDALHMQALPPR |
| 960 | CTsp-Flag- GSlinker-bc40- GSlinker-CD8H-TM-41BB-CD3ζ | MAFLWLLSCWALLGTTFGDYKDDDDKGGGGSGGGGSMGSWSEF WVRLGAIRERLDALGGSEAELAAFEKEIAAFESELQAYKGKGN PEVEKLRYTAATIRRFLQAYRHNGGGGSGGGGSGTTTPAPRPP TPAPTIASQPLSLRPEACRPAAGGAVHTRGLDFACDIYIWAPL AGTCGVLLLSLVITLYCKRGRKKLLYIFKQPFMRPVQTTQEED GCSCRFPEEEEGGCELRVKFSRSADAPAYKQGQNQLYNELNLG RREEYDVLDKRRGRDPEMGGKPRRKNPQEGLYNELQKDKMAEA YSEIGMKGERRRGKGHDGLYQGLSTATKDTYDALHMQALPPR |
| 961 | CTsp-Flag- GSlinker-af03- GSlinker-CD8H-TM-41BB-CD3ζ | MAFLWLLSCWALLGTTFGDYKDDDDKGGGGSGGGGSMGSWFEF YDRLNAIDARLWALGGSEAELAAFEKEIAAFESELQAYKGKGN PEVENLRVHAAAIREWLQAYRHNGGGGSGGGGSGTTTPAPRPP TPAPTIASMGSWAEFKQRLAAIKTRLEALGGSEAELAAFEKEI AAFESELQAYKGKGNPEVEALRKEAAAIRDELQAYRHNQPLSL RPEACRPAAGGAVHTRGLDFACDIYIWAPLAGTCGVLLLSLVI TLYCKRGRKKLLYIFKQPFMRPVQTTQEEDGCSCRFPEEEEGG CELRVKFSRSADAPAYKQGQNQLYNELNLGRREEYDVLDKRRG RDPEMGGKPRRKNPQEGLYNELQKDKMAEAYSEIGMKGERRRG KGHDGLYQGLSTATKDTYDALHMQALPPR |

TABLE 4-continued

Exemplary ADBD CAR Sequences

| SEQ ID NO: | CAR Design | CAR Sequence |
|---|---|---|
| 962 | CTsp-Flag- GSlinker-af05-GSlinker-CD8H-TM-41BB-CD3ζ | MAFLWLLSCWALLGTTFGDYKDDDDKGGGGSGGGGSMGSWLEF YHRLNAIDSRLWALGGSEAELAAFEKEIAAFESELQAYKGKGN PEVESLRDHAAHIREWLQAYRHNGGGGSGGGGSGTTTPAPRPP TPAPTIASQPLSLRPEACRPAAGGAVHTRGLDFACDIYIWAPL AGTCGVLLLSLVITLYCKRGRKKLLYIFKQPFMRPVQTTQEED GCSCRFPEEEEGGCELRVKFSRSADAPAYKQGQNQLYNELNLG RREEYDVLDKRRGRDPEMGGKPRRKNPQEGLYNELQKDKMAEA YSEIGMKGERRRGKGHDGLYQGLSTATKDTYDALHMQALPPR |

SEQUENCE LISTING (976 sequences)

SEQ ID NO: 1 - protein, 73 aa, ARTIFICIAL SEQUENCE
  synthetic construct
MGSWAEFKQRLAAIKTRLQALGGSEAELAAFEKEIAAFESELQAYKGKGNPEVEALRKEAAAIRDELQAYRHN

SEQ ID NO: 2 - protein, 9 aa, ARTIFICIAL SEQUENCE
  synthetic construct
LAAIKTRLQ

SEQ ID NO: 3 - protein, 229 aa, Homo sapiens
LEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 4 - protein, 10 aa, ARTIFICIAL SEQUENCE
  synthetic construct
GGGGTGGGGS

SEQ ID NO: 5 - protein, 10 aa, ARTIFICIAL SEQUENCE
  synthetic construct
GGGGDGGGGS

SEQ ID NO: 6 - protein, 73 aa, ARTIFICIAL SEQUENCE
  synthetic construct
MGSWAEFKQRLAAIKTRLEALGGSEAELAAFEKEIAAFESELQAYKGKGNPEVEALRKEAAAIRDELQAYRHN

SEQ ID NO: 7 - protein, 54 aa, Homo sapiens
MLQMAGQCSQNEYFDSLLHACIPCQLRCSSNTPPLTCQRYCNASVTNSVKGTNA

SEQ ID NO: 8 - protein, 287 aa, Homo sapiens
TKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWR

SEQ ID NO: 9 - protein, 591 aa, Homo sapiens
RTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 10 - protein, 229 aa, ARTIFICIAL SEQUENCE; identical to SEQ ID NO: 3
  synthetic construct

SEQ ID NO: 11 - protein, 73 aa, ARTIFICIAL SEQUENCE
  synthetic construct
MGSWYEFSWRLQAIHQRLNALGGSEAELAAFEKEIAAFESELQAYKGKGNPEVEELRAYAAGIRGALQAYRHN

SEQ ID NO: 12 - protein, 73 aa, ARTIFICIAL SEQUENCE
  synthetic construct
MGSWHEFTWRLIAIQQRLEALGGSEAELAAFEKEIAAFESELQAYKGKGNPEVEELRAYAAGIRHHLQAYRHN

SEQ ID NO: 13 - protein, 73 aa, ARTIFICIAL SEQUENCE
  synthetic construct
MGSWREFAWRLVAINSRLKALGGSEAELAAFEKEIAAFESELQAYKGKGNPEVEELRHYAASIRDGLQAYRHN

SEQ ID NO: 14 - protein, 73 aa, ARTIFICIAL SEQUENCE
  synthetic construct
MGSWHEFAWRLQAINQRLNALGGSEAELAAFEKEIAAFESELQAYKGKGNPEVEELRHYAAHIRNGLQAYRHN

SEQ ID NO: 15 - protein, 73 aa, ARTIFICIAL SEQUENCE
  synthetic construct
MGSWNEFAWRLTAIEQRLMALGGSEAELAAFEKEIAAFESELQAYKGKGNPEVEELRHYAAGIRDNLQAYRHN

SEQ ID NO: 16 - protein, 73 aa, ARTIFICIAL SEQUENCE
  synthetic construct
MGSWTEFAWRLQAIHQRLQALGGSEAELAAFEKEIAAFESELQAYKGKGNPEVEELRVYAAKIRISLQAYRHN

SEQ ID NO: 17 - protein, 73 aa, ARTIFICIAL SEQUENCE
  synthetic construct
MGSWIEFAWRLQAIHQRLDALGGSEAELAAFEKEIAAFESELQAYKGKGNPEVEDLREYAANIRDSLQAYRHN

SEQ ID NO: 18 - protein, 73 aa, ARTIFICIAL SEQUENCE
  synthetic construct
MGSWHEFTWRLVAIQQRLQALGGSEAELAAFEKEIAAFESELQAYKGKGNPEVEELRKFAAKIRYELQAYRHN

SEQ ID NO: 19 - protein, 73 aa, ARTIFICIAL SEQUENCE
  synthetic construct
MGSWHEFTWRLIAIRERLFALGGSEAELAAFEKEIAAFESELQAYKGKGNPEVEELREYAASIRNMLQAYRHN

SEQ ID NO: 20 - protein, 73 aa, ARTIFICIAL SEQUENCE
  synthetic construct
MGSWIEFSWRLEAIRQRLQALGGSEAELAAFEKEIAAFESELQAYKGKGNPEVESLRSYAARIRQELQAYRHN

SEQ ID NO: 21 - protein, 73 aa, ARTIFICIAL SEQUENCE
  synthetic construct
MGSWVEFSWRLEAIRQRLQALGGSEAELAAFEKEIAAFESELQAYKGKGNPEVESLRSYAARIRQELQAYRHN

SEQ ID NO: 22 - protein, 73 aa, ARTIFICIAL SEQUENCE
  synthetic construct
MGSWVEFSWRLEAIRQRLTALGGSEAELAAFEKEIAAFESELQAYKGKGNPEVEDLRKYAARIRGELQAYRHN

SEQ ID NO: 23 - protein, 73 aa, ARTIFICIAL SEQUENCE
  synthetic construct
MGSWVEFAWRLTAIDQRLSALGGSEAELAAFEKEIAAFESELQAYKGKGNPEVENLRFYAAKIRSHLQAYRHN

SEQ ID NO: 24 - protein, 73 aa, ARTIFICIAL SEQUENCE
  synthetic construct
MGSWVEFAWRLEAIKQRLTALGGSEAELAAFEKEIAAFESELQAYKGKGNPEVEELRLYAAKIRRVLQAYRHN

SEQ ID NO: 25 - protein, 73 aa, ARTIFICIAL SEQUENCE
  synthetic construct
MGSWVEFAWRLTAIHTRLWALGGSEAELAAFEKEIAAFESELQAYKGKGNPEVESLRKYAAKIRKQLQAYRHN

SEQ ID NO: 26 - protein, 73 aa, ARTIFICIAL SEQUENCE
  synthetic construct
MGSWTEFAWRLEAINQRLQALGGSEAELAAFEKEIAAFESELQAYKGKGKPEVEALRAYAAKIRTRLQAYRHN

SEQ ID NO: 27 - protein, 73 aa, ARTIFICIAL SEQUENCE
  synthetic construct
MGSWSEFAWRLEAIHQRLSALGGSEAELAAFEKEIAAFESELQAYKGKGNPEVESLRLFAAQIRENLQAYRHN

SEQ ID NO: 28 - protein, 73 aa, ARTIFICIAL SEQUENCE
  synthetic construct
MGSWNEFAWRLIAINQRLWALGGSEAELAAFEKEIAAFESELQAYKGKGNPEVESLRHFAANIRNDLQAYRHN

SEQ ID NO: 29 - protein, 73 aa, ARTIFICIAL SEQUENCE
  synthetic construct
MGSWTEFAWRLIAIDQRLMALGGSEAELAAFEKEIAAFESELQAYKGKGNPEVEILRELAAEIRFHLQAYRHN

SEQ ID NO: 30 - protein, 73 aa, ARTIFICIAL SEQUENCE
  synthetic construct
MGSWSEFMNRLDAITYRLVALGGSEAELAAFEKEIAAFESELQAYKGKGNPEVELLRHYAAQIRDSLQAYRHN

SEQ ID NO: 31 - protein, 73 aa, ARTIFICIAL SEQUENCE
  synthetic construct
MGSWTEFMERLDAISYRLWALGGSEAELAAFEKEIAAFESELQAYKGKGNPEVEVLRDYAAIIRNSLQAYRHN

SEQ ID NO: 32 - protein, 73 aa, ARTIFICIAL SEQUENCE
  synthetic construct
MGSWAEFMDRLDAITYRLWALGGSEAELAAFEKEIAAFESELQAYKGKGNPEVEELRGYAAIIRSELQAYRHN

SEQ ID NO: 33 - protein, 73 aa, ARTIFICIAL SEQUENCE
  synthetic construct
MGSWIEFQERLDAIFYRLHALGGSEAELAAFEKEIAAFESELQAYKGKGNPEVEDLRDAAATIRRQLQAYRHN

SEQ ID NO: 34 - protein, 73 aa, ARTIFICIAL SEQUENCE
  synthetic construct
MGSWIEFQQRLDAIFYRLYALGGSEAELAAFEKEIAAFESELQAYKGKGNPEVENLRDMAAIIRKQLQAYRHN

SEQ ID NO: 35 - protein, 73 aa, ARTIFICIAL SEQUENCE
  synthetic construct
MGSWYEFQSRLDAIFYRLFALGGSEAELAAFEKEIAAFESELQAYKGKGNPEVEKLREAAASIRTQLQAYRHN

SEQ ID NO: 36 - protein, 73 aa, ARTIFICIAL SEQUENCE
  synthetic construct
MGSWSEFIDRLDAITYRLFALGGSEAELAAFEKEIAAFESELQAYKGKGNPEVENLRWYAGVIREQLQAYRHN

SEQ ID NO: 37 - protein, 73 aa, ARTIFICIAL SEQUENCE
  synthetic construct
MGSWSEFYDRLYAINQRLFALGGSEAELAAFEKEIAAFESELQAYKGKGNPEVEDLRWYAAFIRAQLQAYRHN

SEQ ID NO: 38 - protein, 73 aa, ARTIFICIAL SEQUENCE
  synthetic construct
MGSWYEFYDRLDAIVHRLDALGGSEAELAAFEKEIAAFESELQAYKGKGNPEVENLRWYAAMIRVRLQAYRHN

SEQ ID NO: 39 - protein, 73 aa, ARTIFICIAL SEQUENCE
  synthetic construct
MGSWVEFQDRLEAITDRLYALGGSEAELAAFEKEIAAFESELQAYKGKGNPEVEELRYSAAMIRVILQAYRHN

SEQ ID NO: 40 - protein, 73 aa, ARTIFICIAL SEQUENCE
  synthetic construct
MGSWVEFQERLMAISDRLYALGGSEAELAAFEKEIAAFESELQAYKGKGNPEVEELRWQAAMIRYTLQAYRHN

SEQ ID NO: 41 - protein, 73 aa, ARTIFICIAL SEQUENCE
  synthetic construct
MGSWFEFQHRLEAISMRLHALGGSEAELAAFEKEIAAFESELQAYKGKGNPEVEELRWQAAYIRVVLQAYRHN

SEQ ID NO: 42 - protein, 73 aa, ARTIFICIAL SEQUENCE
  synthetic construct
MGSWVEFQSRLEAIATRLRALGGSEAELAAFEKEIAAFESELQAYKGKGNPEVEELRWQAAWIRMMLQAYRHN

SEQ ID NO: 43 - protein, 73 aa, ARTIFICIAL SEQUENCE
  synthetic construct
MGSWEEFQYRLGAIAARLQALGGSEAELAAFEKEIAAFESELQAYKGKGNPEVEELRWQAAMIRFMLQAYRHN

SEQ ID NO: 44 - protein, 73 aa, ARTIFICIAL SEQUENCE
  synthetic construct
MGSWYEFQVRLQAISWRLKALGGSEAELAAFEKEIAAFESELQAYKGKGNHEVEELRIQAALIRVMLQAYRHN

SEQ ID NO: 45 - protein, 73 aa, ARTIFICIAL SEQUENCE
  synthetic construct
MGSWVEFRSRLEAISNRLRALGGSEAELAAFEKEIAAFESELQAYKGKGNPEVEELRTTAALIRVYLQAYRHN

SEQ ID NO: 46 - protein, 73 aa, ARTIFICIAL SEQUENCE
  synthetic construct
MGSWVEFKARLEAISSRLTALGGSEAELAAFEKEIAAFESELQAYKGKGNPEVEELRYSAALIRVYLQAYRHN

SEQ ID NO: 47 - protein, 73 aa, ARTIFICIAL SEQUENCE
  synthetic construct
MGSWSEFYTRLEAINNRLHALGGSEAELAAFEKEIAAFESELQAYKGKGNPEVEELRYTAALIRIYLQAYRHN

SEQ ID NO: 48 - protein, 73 aa, ARTIFICIAL SEQUENCE
  synthetic construct
MGSWAEFYHRLDAISSRLRALGGSEAELAAFEKEIAAFESELQAYKGKGNPEVEELRYTAALIRIYLQAYRHN

SEQ ID NO: 49 - protein, 73 aa, ARTIFICIAL SEQUENCE
  synthetic construct
MGSWTEFASRLVAIRQRLQALGGSEAELAAFEKEIAAFESELQAYKGKGNPEVEELRYSAAIIRVMLQAYRHN

SEQ ID NO: 50 - protein, 73 aa, ARTIFICIAL SEQUENCE
  synthetic construct
MGSWSEFDQRLAAIYQRLNALGGSEAELAAFEKEIAAFESELQAYKGKGNPEVEELRYSAALIRVMLQAYRHN

SEQ ID NO: 51 - protein, 73 aa, ARTIFICIAL SEQUENCE
  synthetic construct
MGSWVEFHNRLSAISDRLGALGGSEAELAAFEKEIAAFESELQAYKGKGNPEVEELRYSAALIRVMLQAYRHN

SEQ ID NO: 52 - protein, 73 aa, ARTIFICIAL SEQUENCE
  synthetic construct
MGSWNEFEDRLSAISARLSALGGSEAELAAFEKEIAAFESELQAYKGKGNPEVEELRYSAALIRVMLQAYRHN

SEQ ID NO: 53 - protein, 73 aa, ARTIFICIAL SEQUENCE
  synthetic construct
MGSWVEFEYRLVAIFDRLQALGGSEAELAAFEKEIAAFESELQAYKGKGNPEVEELRYQAALIRVMLQAYRHN

SEQ ID NO: 54 - protein, 73 aa, ARTIFICIAL SEQUENCE
  synthetic construct
MGSWVEFQGRLGAIHERLQALGGSEAELAAFEKEIAAFESELQAYKGKGNPEVEELRYSAALIRVFLQAYRHN

SEQ ID NO: 55 - protein, 73 aa, ARTIFICIAL SEQUENCE
  synthetic construct
MGSWYEFSMRLSAIWERLHALGGSEAELAAFEKEIAAFESELQAYKGKGNPEVEELRYQAALIRFYLQAYRHN

SEQ ID NO: 56 - protein, 73 aa, ARTIFICIAL SEQUENCE
  synthetic construct
MGSWTEFSQRLGAISERLYALGGSEAELAAFEKEIAAFESELQAYKGKGNPEVEELRYSAALIRFMLQAYRHN

SEQ ID NO: 57 - protein, 73 aa, ARTIFICIAL SEQUENCE
  synthetic construct
MGSWTEFHDRLEAITHRLNALGGSEAELAAFEKEIAAFESELQAYKGKGNPEVEELRYSAALLRVFLQAYRHN

SEQ ID NO: 58 - protein, 73 aa, ARTIFICIAL SEQUENCE
  synthetic construct
MGSWTEFEHRLEAIAGRLNALGGSEAELAAFEKEIAAFESELQAYKGKGNPEVEELRYSAALIRFWLQAYRHN

SEQ ID NO: 59 - protein, 73 aa, ARTIFICIAL SEQUENCE
  synthetic construct
MGSWTEFANRLEAINARLHALGGSEAELAAFEKEIAAFESELQAYKGKGNPEVEELRFSAALIRVYLQAYRHN

SEQ ID NO: 60 - protein, 73 aa, ARTIFICIAL SEQUENCE
  synthetic construct
MGSWEEFDRRLYAIARRLEALGGSEAELAAFEKEIAAFESELQAYKGKGNPEVEELRYQAALIRVWLQAYRHN

SEQ ID NO: 61 - protein, 73 aa, ARTIFICIAL SEQUENCE
  synthetic construct
MGSWIEFHQRLEAIVTRLEALGGSEAELAAFEKEIAAFESELQAYKGKGNPEVEELRYQAALIRVFLQAYRHN

SEQ ID NO: 62 - protein, 73 aa, ARTIFICIAL SEQUENCE
  synthetic construct
MGSWSEFYDRLKAIADRLHALGGSEAELAAFEKEIAAFESELQAYKGKGNPEVEELRTEAAIIRVYLQAYRHN

SEQ ID NO: 63 - protein, 73 aa, ARTIFICIAL SEQUENCE
  synthetic construct
MGSWWEFEDRLSAIMERLHALGGSEAELAAFEKEIAAFESELQAYKGKGNPEVEELRYRAAIIRVYLQAYRHN

SEQ ID NO: 64 - protein, 73 aa, ARTIFICIAL SEQUENCE
  synthetic construct
MGSWVEFEERLAAIATRLHALGGSEAELAAFEKEIAAFESELQAYKGKGNPEVEELRWRAAIIRVYLQAYRHN

SEQ ID NO: 65 - protein, 73 aa, ARTIFICIAL SEQUENCE
  synthetic construct
MGSWSEFRGRLQAIHSRLNALGGSEAELAAFEKEIAAFESELQAYKGKGNPEVEELRYSAAIIRIYLQAYRHN

SEQ ID NO: 66 - protein, 73 aa, ARTIFICIAL SEQUENCE
  synthetic construct
MGSWTEFRDRLGAIYHRLDALGGSEAELAAFEKEIAAFESELQAYKGKGNPEVEELRYQAAIIRVYLQAYRHN

SEQ ID NO: 67 - protein, 73 aa, ARTIFICIAL SEQUENCE
  synthetic construct
MGSWVEFYHRLEAIRYRLSALGGSEAELAAFEKEIAAFESELQAYKGKGNPEVEELRYVAAVIRYRLQAYRHN

SEQ ID NO: 68 - protein, 73 aa, ARTIFICIAL SEQUENCE
  synthetic construct
MGSWVEFYDRLEAIRYRLSALGGSEAELAAFEKEIAAFESELQAYKGKGNPEVEELRYIAAVIRYRLQAYRHN

SEQ ID NO: 69 - protein, 73 aa, ARTIFICIAL SEQUENCE
  synthetic construct
MGSWVEFYDRLAAIRKRLYALGGSEAELAAFEKEIAAFESELQAYKGKGNPEVEELRFRAALIRIWLQAYRHN

SEQ ID NO: 70 - protein, 73 aa, ARTIFICIAL SEQUENCE
  synthetic construct
MGSWEEFSERLEAISIRLRALGGSEAELAAFEKEIAAFESELQAYKGKGNPEVEELRVSAAIIRVWLQAYRHN

SEQ ID NO: 71 - protein, 73 aa, ARTIFICIAL SEQUENCE
  synthetic construct
MGSWSEFSDRLHAISDRLQALGGSEAELAAFEKEIAAFESELQAYKGKGNPEVEELRIQAAIIRVWLQAYRHN

SEQ ID NO: 72 - protein, 73 aa, ARTIFICIAL SEQUENCE
  synthetic construct
MGSWIEFSHRLEAIVDRLGALGGSEAELAAFEKEIAAFESELQAYKGKGNPEVEELRNTAAIIRVYLQAYRHN

SEQ ID NO: 73 - protein, 73 aa, ARTIFICIAL SEQUENCE
  synthetic construct
MGSWEEFSDRLEAILRRLDALGGSEAELAAFEKEIAAFESELQAYKGKGNPEVEDLRFAAAIIRVQLQAYRHN

SEQ ID NO: 74 - protein, 73 aa, ARTIFICIAL SEQUENCE
  synthetic construct
MGSWMEFSHRLDAIHERLYALGGSEAELAAFEKEIAAFESELQAYKGKGNPEVEDLRFAAAIIRVQLQAYRHN

SEQ ID NO: 75 - protein, 73 aa, ARTIFICIAL SEQUENCE
  synthetic construct
MGSWSEFQQRLHAIRTRLYALGGSEAELAAFEKEIAAFESELQAYKGKGNPEVEELRFEAAIIRVMLQAYRHN

SEQ ID NO: 76 - protein, 73 aa, ARTIFICIAL SEQUENCE
  synthetic construct
MGSWYEFQNRLGAINRRLNALGGSEAELAAFEKEIAAFESELQAYKGKGNPEVEELRFEAAIIRVMLQAYRHN

SEQ ID NO: 77 - protein, 73 aa, ARTIFICIAL SEQUENCE
  synthetic construct
MGSWQEFTGRLHAIRHRLEALGGSEAELAAFEKEIAAFESELQAYKGKGNPEVEELRFEAAYIRVWLQAYRHN

SEQ ID NO: 78 - protein, 73 aa, ARTIFICIAL SEQUENCE
  synthetic construct
MGSWTEFDHRLGAIWERLVALGGSEAELAAFEKEIAAFESELQAYKGKGNPEVEELRFHAAIIRIFLQAYRHN

SEQ ID NO: 79 - protein, 73 aa, ARTIFICIAL SEQUENCE
  synthetic construct
MGSWTEFHVRLSAIWDRLVALGGSEAELAAFEKEIAAFESELQAYKGKGNPEVEELRFHAAIIRIVLQAYRHN

SEQ ID NO: 80 - protein, 73 aa, ARTIFICIAL SEQUENCE
  synthetic construct
MGSWNEFDNRLQAIWDRLHALGGSEAELAAFEKEIAAFESELQAYKGKGNPEVEELRFHAAMIRITLQAYRHN

SEQ ID NO: 81 - protein, 73 aa, ARTIFICIAL SEQUENCE
  synthetic construct
MGSWTEFHERLQAIWFRLHALGGSEAELAAFEKEIAAFESELQAYKGKGNPEVEELRFRAAIIRLYLQAYRHN

SEQ ID NO: 82 - protein, 73 aa, ARTIFICIAL SEQUENCE
  synthetic construct
MGSWNEFSGRLTAIKDRLAALGGSEAELAAFEKEIAAFESELQAYKGKGNPEVEELRFRAAVIRLWLQAYRHN

SEQ ID NO: 83 - protein, 73 aa, ARTIFICIAL SEQUENCE
  synthetic construct
MGSWVEFDERLVAIWFRLHALGGSEAELAAFEKEIAAFESELQAYKGKGNPEVEALRARAAYIRIWLQAYRHN

SEQ ID NO: 84 - protein, 73 aa, ARTIFICIAL SEQUENCE
  synthetic construct
MGSWSEFGQRLSAIWERLLALGGSEAELAAFEKEIAAFESELQAYKGKGNPEVEALRADAAFIRIWLQAYRHN

SEQ ID NO: 85 - protein, 73 aa, ARTIFICIAL SEQUENCE
  synthetic construct
MGSWYEFEDRLVAIWIRLDALGGSEAELAAFEKEIAAFESELQAYKGKGNPEVEELRYNAAFIRGALQAYRHN

SEQ ID NO: 86 - protein, 73 aa, ARTIFICIAL SEQUENCE
  synthetic construct
MGSWYEFGDRLSAIWERLAALGGSEAELAAFEKEIAAFESELQAYKGKGNPEVEYLRTHAAEIRTILQAYRHN

SEQ ID NO: 87 - protein, 73 aa, ARTIFICIAL SEQUENCE
  synthetic construct
MGSWHEFYYRLEAIEQRLHALGGSEAELAAFEKEIAAFESELQAYKGKGNPEVETLRFDAALIRIYLQAYRHN

SEQ ID NO: 88 - protein, 73 aa, ARTIFICIAL SEQUENCE
  synthetic construct
MGSWSEFEERLAAIGSRLFALGGSEAELAAFEKEIAAFESELQAYKGKGNPEVETLRFDAALIRIYLQAYRHN

SEQ ID NO: 89 - protein, 73 aa, ARTIFICIAL SEQUENCE
  synthetic construct
MGSWLEFHYRLHAIQFRLYALGGSEAELAAFEKEIAAFESELQAYKGKGNPEVETLRHIAALIRNQLQAYRHN

SEQ ID NO: 90 - protein, 73 aa, ARTIFICIAL SEQUENCE
  synthetic construct
MGSWQEFYNRLEAIHMRLFALGGSEAELAAFEKEIAAFESELQAYKGKGNPEVEGLRSDAAPIRDVLQAYRHN

SEQ ID NO: 91 - protein, 73 aa, ARTIFICIAL SEQUENCE
  synthetic construct
MGSWNEFHHRLWAIFDRLGALGGSEAELAAFEKEIAAFESELQAYKGKGNPEVEVLRKMAAGIRGGLQAYRHN

SEQ ID NO: 92 - protein, 73 aa, ARTIFICIAL SEQUENCE
  synthetic construct
MGSWYEFHYRLKAINDRLYALGGSEAELAAFEKEIAAFESELQAYKGKGNPEVEYLRYSAAMIRHKLQAYRHN

SEQ ID NO: 93 - protein, 73 aa, ARTIFICIAL SEQUENCE
  synthetic construct
MGSWTEFHQRLGAIHARLGALGGSEAELAAFEKEIAAFESELQAYKGKGNPEVEYLRFSAAFIRLKLQAYRHN

SEQ ID NO: 94 - protein, 73 aa, ARTIFICIAL SEQUENCE
  synthetic construct
MGSWFEFQYRLEAIFYRLLALGGSEAELAAFEKEIAAFESELQAYKGKGKPEVEELRVRAALIRHLLQAYRHN

SEQ ID NO: 95 - protein, 73 aa, ARTIFICIAL SEQUENCE
  synthetic construct
MGSWVEFHARLDAIYTRLGALGGSEAELAAFEKEIAAFESELQAYKGKGNPEVEYLRVLAAHIRISLQAYRHN

SEQ ID NO: 96 - protein, 73 aa, ARTIFICIAL SEQUENCE
  synthetic construct
MGSWVEFGTRLSAIYNRLWALGGSEAELAAFEKEIAAFESELQAYKGKGNPEVEDLRFEAAIIRIMLQAYRHN

SEQ ID NO: 97 - protein, 73 aa, ARTIFICIAL SEQUENCE
  synthetic construct
MGSWVEFTHRLDAIYIRLWALGGSEAELAAFEKEIAAFESELQAYKGKGNPEVEELRHEAAVIREELQAYRHN

SEQ ID NO: 98 - protein, 73 aa, ARTIFICIAL SEQUENCE
  synthetic construct
MGSWVEFHGRLAAIYVRLFALGGSEAELAAFEKEIAAFESELQAYKGKGNPEVESLRYHAAMIRRNLQAYRHN

SEQ ID NO: 99 - protein, 73 aa, ARTIFICIAL SEQUENCE
  synthetic construct
MGSWVEFDRRLVAIYIRLWALGGSEAELAAFEKEIAAFESELQAYKGKGNPEVEALRDDAALIRLLLQAYRHN

SEQ ID NO: 100 - protein, 73 aa, ARTIFICIAL SEQUENCE
  synthetic construct
MGSWVEFDRRLVAIYIRLWALGGSEAELAAFEKEIAAFESELQAYKGKGNPEVEKLRYDAATIRETLQAYRHN

SEQ ID NO: 101 - protein, 73 aa, ARTIFICIAL SEQUENCE
  synthetic construct
MGSWLEFDRRLTAIYLRLWALGGSEAELAAFEKEIAAFESELQAYKGKGNPEVEALREDAAMIRDMLQAYRHN

SEQ ID NO: 102 - protein, 73 aa, ARTIFICIAL SEQUENCE
  synthetic construct
MGSWIEFDRRLLAIHVRLWALGGSEAELAAFEKEIAAFESELQAYKGKGNPEVEVLRADAAKIRMELQAYRHN

SEQ ID NO: 103 - protein, 73 aa, ARTIFICIAL SEQUENCE
  synthetic construct
MGSWIEFDRRLIAIWIRLWALGGSEAELAAFEKEIAAFESELQAYKGKGNPEVESLRSDAADIRQKLQAYRHN

SEQ ID NO: 104 - protein, 73 aa, ARTIFICIAL SEQUENCE
  synthetic construct
MGSWVEFDRRLIAIWVRLWALGGSEAELAAFEKEIAAFESELQAYKGKGNPEVEFLRSDAAMIREHLQAYRHN

SEQ ID NO: 105 - protein, 73 aa, ARTIFICIAL SEQUENCE
  synthetic construct
MGSWYEFHTRLIAIYVRLWALGGSEAELAAFEKEIAAFESELQAYKGKGNPEVEWLRGDAAKIRGYLQAYRHN

SEQ ID NO: 106 - protein, 73 aa, ARTIFICIAL SEQUENCE
  synthetic construct
MGSWSEFSTRLSAIYVRLWALGGSEAELAAFEKEIAAFESELQAYKGKGNPEVEYLRNKAASIRKTLQAYRHN

SEQ ID NO: 107 - protein, 73 aa, ARTIFICIAL SEQUENCE
  synthetic construct
MGSWVEFRYRLGAIYHRLWALGGSEAELAAFEKEIAAFESELQAYKGKGNPEVEVLRDRAATIRRLLQAYRHN

SEQ ID NO: 108 - protein, 73 aa, ARTIFICIAL SEQUENCE
  synthetic construct
MGSWNEFRNRLGAIDSRLWALGGSEAELAAFEKEIAAFESELQAYKGKGNPEVETLRAHAAIIRSVLQAYRHN

SEQ ID NO: 109 - protein, 73 aa, ARTIFICIAL SEQUENCE
  synthetic construct
MGSWHEFRNRLGAIDSRLWALGGSEAELAAFEKEIAAFESELQAYKGKGNPEVETLRARAAMIRSVLQAYRHN

SEQ ID NO: 110 - protein, 73 aa, ARTIFICIAL SEQUENCE
  synthetic construct
MGSWTEFYQRLEAINFRLWALGGSEAELAAFEKEIAAFESELQAYKGKGNPEVEVLRDKAALIRLMLQAYRHN

SEQ ID NO: 111 - protein, 73 aa, ARTIFICIAL SEQUENCE
  synthetic construct
MGSWNEFYNRLHAINLRLWALGGSEAELAAFEKEIAAFESELQAYKGKGNPEVEVLREHAAIIRQALQAYRHN

SEQ ID NO: 112 - protein, 73 aa, ARTIFICIAL SEQUENCE
  synthetic construct
MGSWEEFYGRLSAIQDRLWALGGSEAELAAFEKEIAAFESELQAYKGKGNPEVEWLRMHAAVIRRALQAYRHN

SEQ ID NO: 113 - protein, 73 aa, ARTIFICIAL SEQUENCE
  synthetic construct
MGSWGEFNLRLVAIHVRLWALGGSEAELAAFEKEIAAFESELQAYKGKGNPEVEFLRSQAANIRAQLQAYRHN

SEQ ID NO: 114 - protein, 73 aa, ARTIFICIAL SEQUENCE
  synthetic construct
MGSWGEFSDRLEAINERLWALGGSEAELAAFEKEIAAFESELQAYKGKGNPEVEELRWQAAFIRANLQAYRHN

SEQ ID NO: 115 - protein, 73 aa, ARTIFICIAL SEQUENCE
  synthetic construct
MGSWMEFQGRLPAILARLRALGGSEAELAAFEKEIAAFESELQAYKGKGNPEVEHLRDKAAYIRWMLQAYRHN

SEQ ID NO: 116 - protein, 73 aa, ARTIFICIAL SEQUENCE
  synthetic construct
MGSWMEFEGRLPAILARLRALGGSEAELAAFEKEIAAFESELQAYKGKGNPEVEHLRDKAAYIRWMLQAYRHN

SEQ ID NO: 117 - protein, 73 aa, ARTIFICIAL SEQUENCE
  synthetic construct
MGSWFEFQNRLQAILFRLRALGGSEAELAAFEKEIAAFESELQAYKGKGNPEVENLRDKAAYIRLMLQAYRHN

SEQ ID NO: 118 - protein, 73 aa, ARTIFICIAL SEQUENCE
  synthetic construct
MGSWVEFDMRLQAILERLRALGGSEAELAAFEKEIAAFESELQAYKGKGNPEVEHLRDSAAYIRLMLQAYRHN

SEQ ID NO: 119 - protein, 73 aa, ARTIFICIAL SEQUENCE
  synthetic construct
MGSWVEFNARLDAILFRLRALGGSEAELAAFEKEIAAFESELQAYKGKGNPEVEHLRDQAAYIRLMLQAYRHN

SEQ ID NO: 120 - protein, 73 aa, ARTIFICIAL SEQUENCE
  synthetic construct
MGSWMEFNVRLRAILDRLHALGGSEAELAAFEKEIAAFESELQAYKGKGNPEVELLRDKAAYIRFMLQAYRHN

SEQ ID NO: 121 - protein, 73 aa, ARTIFICIAL SEQUENCE
  synthetic construct
MGSWIEFDTRLAAIVHRLRALGGSEAELAAFEKEIAAFESELQAYKGKGNPEVELLRDKAAYIRYMLQAYRHN

SEQ ID NO: 122 - protein, 73 aa, ARTIFICIAL SEQUENCE
  synthetic construct
MGSWIEFDYRLKAILHRLRALGGSEAELAAFEKEIAAFESELQAYKGKGNPEVEGLRDKAAYIRFLLQAYRHN

SEQ ID NO: 123 - protein, 73 aa, ARTIFICIAL SEQUENCE
  synthetic construct
MGSWYEFEDRLLAIKVRLRALGGSEAELAAFEKEIAAFESELQAYKGKGNPEVEYLRDQAAYIRFMLQAYRHN

SEQ ID NO: 124 - protein, 73 aa, ARTIFICIAL SEQUENCE
  synthetic construct
MGSWYEFQDRLSAITTRLRALGGSEAELAAFEKEIAAFESELQAYKGKGNPEVELLRDKAAYIRFMLQAYRHN

SEQ ID NO: 125 - protein, 73 aa, ARTIFICIAL SEQUENCE
  synthetic construct
MGSWEEFDDRLNAIVYRLRALGGSEAELAAFEKEIAAFESELQAYKGKGNPEVEMLRDQAAYIRLMLQAYRHN

SEQ ID NO: 126 - protein, 73 aa, ARTIFICIAL SEQUENCE
  synthetic construct
MGSWVEFEQRLHAIVVRLRALGGSEAELAAFEKEIAAFESELQAYKGGGNPEVENLRDQAAYIRFMLQAYRHN

SEQ ID NO: 127 - protein, 73 aa, ARTIFICIAL SEQUENCE
  synthetic construct
MGSWVEFEWRLEAIVVRLRALGGSEAELAAFEKEIAAFESELQAYKGKGNPEVEHLRDKAAYIRYMLQAYRHN

SEQ ID NO: 128 - protein, 73 aa, ARTIFICIAL SEQUENCE
  synthetic construct
MGSWYEFEHRLKAIVSRLGALGGSEAELAAFEKEIAAFESELQAYKGKGNPEVEHLRDKAAYIRYMLQAYRHN

SEQ ID NO: 129 - protein, 73 aa, ARTIFICIAL SEQUENCE
  synthetic construct
MGSWMEFKHRLAAITFRLRALGGSEAELAAFEKEIAAFESELQAYKGKGNPEVELLRDKAAYIRLLLQAYRHN

SEQ ID NO: 130 - protein, 73 aa, ARTIFICIAL SEQUENCE
  synthetic construct
MGSWMEFEGRLHAIKRRLRALGGSEAELAAFEKEIAAFESELQAYKGKGNPEVEVLRDQAAYIRLLLQAYRHN

SEQ ID NO: 131 - protein, 73 aa, ARTIFICIAL SEQUENCE
  synthetic construct
MGSWSEFVFRLDTIKSRLRALGGSEAELAAFEKEIAAFESELQAYKGKGNPEVETLRDQAAYIRLMLQAYRHN

SEQ ID NO: 132 - protein, 73 aa, ARTIFICIAL SEQUENCE
  synthetic construct
MGSWYEFDERLSAIKLRLRALGGSEAELAAFEKEIAAFESELQAYKGKGNPEVEVLRAQAAYIRAILQAYRHN

SEQ ID NO: 133 - protein, 73 aa, ARTIFICIAL SEQUENCE
  synthetic construct
MGSWMEFDERLWAIKKRLRALGGSEAELAAFEKEIAAFESELQAYKGKGNPEVEFLRHQAAYIRMLLQAYRHN

SEQ ID NO: 134 - protein, 73 aa, ARTIFICIAL SEQUENCE
  synthetic construct
MGSWHEFDGRLSAIKRRLWALGGSEAELAAFEKEIAAFESELQAYKGKGNPEVEHLRDQAAYIRYMLQAYRHN

SEQ ID NO: 135 - protein, 73 aa, ARTIFICIAL SEQUENCE
  synthetic construct
MGSWYEFDGRLQAIIARLRALGGSEAELAAFEKEIAAFESELQAYKGKGNPEVEHLRFRAAYIRWILQAYRHN

SEQ ID NO: 136 - protein, 73 aa, ARTIFICIAL SEQUENCE
  synthetic construct
MGSWFEFDKRLYAIIHRLRALGGSEAELAAFEKEIAAFESELQAYKGKGNPEVEKLRYKAAIIRLYLQAYRHN

SEQ ID NO: 137 - protein, 73 aa, ARTIFICIAL SEQUENCE
  synthetic construct
MGSWVEFDNRLYAIVDRLRALGGSEAELAAFEKEIAAFESELQAYKGKGNPEVEHLRQKAAYIRLILQAYRHN

SEQ ID NO: 138 - protein, 73 aa, ARTIFICIAL SEQUENCE
  synthetic construct
MGSWIEFHQRLNAIFNRLRALGGSEAELAAFEKEIAAFESELQAYKGKGNPEVEWLRHHAAYIREMLQAYRHN

SEQ ID NO: 139 - protein, 73 aa, ARTIFICIAL SEQUENCE
  synthetic construct
MGSWNEFRLRLWAITERLRALGGSEAELAAFEKEIAAFESELQAYKGKGNPEVECLRAEAAWIRTMLQAYRHN

SEQ ID NO: 140 - protein, 73 aa, ARTIFICIAL SEQUENCE
  synthetic construct
MGSWYEFWLRLSAISYRLQALGGSEAELAAFEKEIAAFESELQAYKGKGNPEVEWLRKEAAEIRSWLQAYRHN

SEQ ID NO: 141 - protein, 73 aa, ARTIFICIAL SEQUENCE
  synthetic construct
MGSWYEFQLRLWAIHWRLIALGGSEAELAAFEKEIAAFESELQAYKGKGNPEVEWLRMRAAEIRNELQAYRHN

SEQ ID NO: 142 - protein, 73 aa, ARTIFICIAL SEQUENCE
  synthetic construct
MGSWYEFAHRLEAIEWRLIALGGSEAELAAFEKEIAAFESELQAYKGKGNPEVEELRQYAAAIRNYLQAYRHN

SEQ ID NO: 143 - protein, 73 aa, ARTIFICIAL SEQUENCE
  synthetic construct
MGSWYEFDTRLGAIRNRLGALGGSEAELAAFEKEIAAFESELQAYKGKGNPEVEWLRFQAAYIRFLLQAYRHN

SEQ ID NO: 144 - protein, 73 aa, ARTIFICIAL SEQUENCE
  synthetic construct
MGSWYEFWVRLTAIRWRLEALGGSEAELAAFEKEIAAFESELQAYKGKGNPEVEWLREQAASIRWVLQAYRHN

SEQ ID NO: 145 - protein, 73 aa, ARTIFICIAL SEQUENCE
  synthetic construct
MGSWFEFDRRLKAIDRRLMALGGSEAELAAFEKEIAAFESELQAYKGKGNPEVEWLRMQAAIIRNYLQAYRHN

SEQ ID NO: 146 - protein, 73 aa, ARTIFICIAL SEQUENCE
  synthetic construct
MGSWVEFWERLDAIDNRLGALGGSEAELAAFEKEIAAFESELQAYKGKGNPEVEWLRWHAAYIRGYLQAYRHN

SEQ ID NO: 147 - protein, 73 aa, ARTIFICIAL SEQUENCE
  synthetic construct
MGSWAEFWDRLDAIDSRLNALGGSEAELAAFEKEIAAFESELQAYKGKGNPEVEYLREWAAYIRGYLQAYRHN

SEQ ID NO: 148 - protein, 73 aa, ARTIFICIAL SEQUENCE
  synthetic construct
MGSWAEFDLRLRAIAKRLVALGGSEAELAAFEKEIAAFESELQAYKGKGNPEVEMLRLDAAYIRGVLQAYRHN

SEQ ID NO: 149 - protein, 73 aa, ARTIFICIAL SEQUENCE
  synthetic construct
MGSWSEFWDRLYAIRIRLDALGGSEAELAAFEKEIAAFESELQAYKGKGNPEVEKLRSVAARIRNWLQAYRHN

SEQ ID NO: 150 - protein, 73 aa, ARTIFICIAL SEQUENCE
  synthetic construct
MGSWSEFWFRLGAIRNRLDALGGSEAELAAFEKEIAAFESELQAYKGKGNPEVEKLRDVAAHIRHWLQAYRHN

SEQ ID NO: 151 - protein, 73 aa, ARTIFICIAL SEQUENCE
  synthetic construct
MGSWSEFNDRLDAIRWRLDALGGSEAELAAFEKEIAAFESELQAYKGKGNPEVEWLRQVAATIRYRLQAYRHN

SEQ ID NO: 152 - protein, 73 aa, ARTIFICIAL SEQUENCE
  synthetic construct
MGSWVEFWDRLGAIRERLQALGGSEAELAAFEKEIAAFESELQAYKGKGNPEVEKLRYTAAAIRHYLQAYRHN

SEQ ID NO: 153 - protein, 73 aa, ARTIFICIAL SEQUENCE
  synthetic construct
MGSWAEFWDRLGAIRERLQALGGSEAELAAFEKEIAAFESELQAYKGKGNPEVEKLRYTAAAIRHYLQAYRHN

SEQ ID NO: 154 - protein, 73 aa, ARTIFICIAL SEQUENCE
  synthetic construct
MGSWTEFWDRLGAIRERLQALGGSEAELAAFEKEIAAFESELQAYKGKGNPEVEKLRYTAAAIRHYLQAYRHN

SEQ ID NO: 155 - protein, 73 aa, ARTIFICIAL SEQUENCE
  synthetic construct
MGSWVEFWDRLGAIRERLQALGGSEAELAAFEKEIAAFESELQAYKGKGNPEVEKLKYTAAAIRHYLQAYRHN

SEQ ID NO: 156 - protein, 73 aa, ARTIFICIAL SEQUENCE
  synthetic construct
MGSWVEFWDRLGAIRERLQALGGSEAELAAFEKEIAAFESELQAYKGKGNPEVEKLQYTAAAIRHYLQAYRHN

SEQ ID NO: 157 - protein, 73 aa, ARTIFICIAL SEQUENCE
  synthetic construct
MGSWVEFWDRLGAIRERLQALGGSEAELAAFEKEIAAFESELQAYKGKGNPEVEKLRYTAAAIKHYLQAYRHN

SEQ ID NO: 158 - protein, 73 aa, ARTIFICIAL SEQUENCE
  synthetic construct
MGSWAEFWDRLGAIRERLQALGGSEAELAAFEKEIAAFESELQAYKGKGNPEVEKLQYTAAAIKHYLQAYRHN

SEQ ID NO: 159 - protein, 73 aa, ARTIFICIAL SEQUENCE
  synthetic construct
MGSWTEFWDRLGAIRERLQALGGSEAELAAFEKEIAAFESELQAYKGKGNPEVEKLQYTAAAIKHYLQAYRHN

SEQ ID NO: 160 - protein, 73 aa, ARTIFICIAL SEQUENCE
  synthetic construct
MGSWVEFWDRLGAIRERLEALGGSEAELAAFEKEIAAFESELQAYKGKGNPEVEKLRYVAAVIRHRLQAYRHN

SEQ ID NO: 161 - protein, 73 aa, ARTIFICIAL SEQUENCE
  synthetic construct
MGSWVEFWDRLGAIRERLQALGGSEAELAAFEKEIAAFESELQAYKGKGNPEVEELRASAAAIRIALQAYRHN

SEQ ID NO: 162 - protein, 73 aa, ARTIFICIAL SEQUENCE
  synthetic construct
MGSWVEFWDRLGAIRDRLDALGGSEAELAAFEKEIAAFESELQAYKGKGNPEVEELRNTAAYIRTFLQAYRHN

SEQ ID NO: 163 - protein, 73 aa, ARTIFICIAL SEQUENCE
  synthetic construct
MGSWSEFWVRLGAIRDRLDALGGSEAELAAFEKEIAAFESELQAYKGKGNPEVEALRVTAAQIRHYLQAYRHN

SEQ ID NO: 164 - protein, 73 aa, ARTIFICIAL SEQUENCE
  synthetic construct
MGSWSEFWVRLGAIRERLDALGGSEAELAAFEKEIAAFESELQAYKGKGNPEVEKLRYTAATIRRFLQAYRHN

SEQ ID NO: 165 - protein, 73 aa, ARTIFICIAL SEQUENCE
  synthetic construct
MGSWSEFWARLGAIRERLDALGGSEAELAAFEKEIAAFESELQAYKGKGNPEVEKLRYTAATIRRFLQAYRHN

SEQ ID NO: 166 - protein, 73 aa, ARTIFICIAL SEQUENCE
  synthetic construct
MGSWSEFWVRLGAIRERLDALGGSEAELAAFEKEIAAFESELQAYKGKGNPEVEKLRYTAGTIRRFLQAYRHN

SEQ ID NO: 167 - protein, 73 aa, ARTIFICIAL SEQUENCE
  synthetic construct
MGSWSEFWVRLGAIRERLDALGGSEAELAAFEKEIAAFESELQAYKGKGNPEVEKLRYTAATIKRFLQAYRHN

SEQ ID NO: 168 - protein, 73 aa, ARTIFICIAL SEQUENCE
  synthetic construct
MGSWSEFWARLGAIRERLDALGGSEAELAAFEKEIAAFESELQAYKGKGNPEVEKLRYTAGTIKRFLQAYRHN

SEQ ID NO: 169 - protein, 73 aa, ARTIFICIAL SEQUENCE
  synthetic construct
MGSWSEFWDRLTAIRVRLDALGGSEAELAAFEKEIAAFESELQAYKGKGNPEVEKLRYTAAHIRKFLQAYRHN

SEQ ID NO: 170 - protein, 73 aa, ARTIFICIAL SEQUENCE
  synthetic construct
MGSWTEFWTRLNAIYERLDALGGSEAELAAFEKEIAAFESELQAYKGKGNPEVEKLRFTAASIRMYLQAYRHN

SEQ ID NO: 171 - protein, 73 aa, ARTIFICIAL SEQUENCE
  synthetic construct
MGSWFEFWDRLAAIRDRLEALGGSEAELAAFEKEIAAFESELQAYKGKGNPEVEDLRYVAAKIRVRLQAYRHN

SEQ ID NO: 172 - protein, 73 aa, ARTIFICIAL SEQUENCE
  synthetic construct
MGSWTEFWVRLNAIRDRLEALGGSEAELAAFEKEIAAFESELQAYKGKGNPEVEDLRHTAAIIRNYLQAYRHN

SEQ ID NO: 173 - protein, 73 aa, ARTIFICIAL SEQUENCE
  synthetic construct
MGSWVEFWHRLGAIYDRLEALGGSEAELAAFEKEIAAFESELQAYKGKGNPEVEELRRTAALIRQTLQAYRHN

SEQ ID NO: 174 - protein, 73 aa, ARTIFICIAL SEQUENCE
  synthetic construct
MGSWVEFWNRLGAIYDRLEALGGSEAELAAFEKEIAAFESELQAYKGKGNPEVEKLRHTAAVIRLYLQAYRHN

SEQ ID NO: 175 - protein, 73 aa, ARTIFICIAL SEQUENCE
  synthetic construct
MGSWSEFWERLEAIYDRLYALGGSEAELAAFEKEIAAFESELQAYKGKGNPEVEELRRTAATIRSFLQAYRHN

SEQ ID NO: 176 - protein, 73 aa, ARTIFICIAL SEQUENCE
  synthetic construct
MGSWEEFDNRLEAIFDRLEALGGSEAELAAFEKEIAAFESELQAYKGKGNPEVEELREFAATIRITLQAYRHN

SEQ ID NO: 177 - protein, 73 aa, ARTIFICIAL SEQUENCE
  synthetic construct
MGSWMEFWDRLYAIEFRLFALGGSEAELAAFEKEIAAFESELQAYKGKGNPEVEKLRRVAATIRNELQAYRHN

SEQ ID NO: 178 - protein, 73 aa, ARTIFICIAL SEQUENCE
  synthetic construct
MGSWTEFWERLYAIEYRLFALGGSEAELAAFEKEIAAFESELQAYKGKGNPEVEKLRSVAATIRYELQAYRHN

SEQ ID NO: 179 - protein, 73 aa, ARTIFICIAL SEQUENCE
  synthetic construct
MGSWNEFWERLYAIELRLFALGGSEAELAAFEKEIAAFESELQAYKGKGNPEVEKLRMTAAYIRNELQAYRHN

SEQ ID NO: 180 - protein, 73 aa, ARTIFICIAL SEQUENCE
  synthetic construct
MGSWYEFWKRLYAIEYRLFALGGSEAELAAFEKEIAAFESELQAYKGKGNPEVEALRKVAAKIREQLQAYRHN

SEQ ID NO: 181 - protein, 73 aa, ARTIFICIAL SEQUENCE
  synthetic construct
MGSWTEFWARLYAIEMRLFALGGSEAELAAFEKEIAAFESELQAYKGKGNPEVEHLRRVAALIREQLQAYRHN

SEQ ID NO: 182 - protein, 73 aa, ARTIFICIAL SEQUENCE
  synthetic construct
MGSWHEFWDRLYAIEFRLFALGGSEAELAAFEKEIAAFESELQAYKGKGNPEVESLRQVAAKIRWHLQAYRHN

SEQ ID NO: 183 - protein, 73 aa, ARTIFICIAL SEQUENCE
  synthetic construct
MGSWDEFEFRLGALRWRLIALGGSEAELAAFEKEIAAFESELQAYKGKGNPEVEYLRFGAAHIRHILQAYRHN

SEQ ID NO: 184 - protein, 73 aa, ARTIFICIAL SEQUENCE
  synthetic construct
MGSWTEFYHRLYAIRERLSALGGSEAELAAFEKEIAAFESELQAYKGKGNPEVEYLRFGAAHIRHLLQAYRHN

SEQ ID NO: 185 - protein, 73 aa, ARTIFICIAL SEQUENCE
  synthetic construct
MGSWVEFETRLDAIRMRLGALGGSEAELAAFEKEIAAFESELQAYKGKGNPEVEYLRFGAAHIRALLQAYRHN

SEQ ID NO: 186 - protein, 73 aa, ARTIFICIAL SEQUENCE
  synthetic construct
MGSWGEFDVRLFAIRERLSALGGSEAELAAFEKEIAAFESELQAYKGKGNPEVEYLRGYAAQIRSFLQAYRHN

SEQ ID NO: 187 - protein, 73 aa, ARTIFICIAL SEQUENCE
  synthetic construct
MGSWVEFDERLSAIRERLDALGGSEAELAAFEKEIAAFESELQAYKGKGNPEVEYLRLYAAQIRVFLQAYRHN

SEQ ID NO: 188 - protein, 73 aa, ARTIFICIAL SEQUENCE
  synthetic construct
MGSWSEFDGRLGAIWDRLYALGGSEAELAAFEKEIAAFESELQAYKGKGNPEVEYLRDRAAQIREFLQAYRHN

SEQ ID NO: 189 - protein, 73 aa, ARTIFICIAL SEQUENCE
  synthetic construct
MGSWGEFEGRLHAIRSRLSALGGSEAELAAFEKEIAAFESELQAYKGKGNPEVEVLRGYAAWIRALLQAYRHN

SEQ ID NO: 190 - protein, 73 aa, ARTIFICIAL SEQUENCE
  synthetic construct
MGSWGEFNGRLGAIRERLQALGGSEAELAAFEKEIAAFESELQAYKGKGNPEVEFLRAYAASIRAVLQAYRHN

SEQ ID NO: 191 - protein, 73 aa, ARTIFICIAL SEQUENCE
  synthetic construct
MGSWWEFTFRLAAIEFRLEALGGSEAELAAFEKEIAAFESELQAYKGKGNPEVEDLRAIAAEIRKSLQAYRHN

SEQ ID NO: 192 - protein, 73 aa, ARTIFICIAL SEQUENCE
  synthetic construct
MGSWDEFQFRLAAIGFRLGALGGSEAELAAFEKEIAAFESELQAYKGKGNPEVEVLRRQAARIRHLLQAYRHN

SEQ ID NO: 193 - protein, 73 aa, ARTIFICIAL SEQUENCE
  synthetic construct
MGSWYEFVTRLHAIDHRLKALGGSEADLAAFEKEIAAFESELQAYKGKGNPEVEWLRFYAAGIRMNLQAYRHN

SEQ ID NO: 194 - protein, 73 aa, ARTIFICIAL SEQUENCE
  synthetic construct
MGSWSIEFWRLEAIKFRLIALGGSEAELAAFEKEIAAFESELQAYKGKGNPEVEFLRVEAAAIRRVLQAYRHN

SEQ ID NO: 195 - protein, 73 aa, ARTIFICIAL SEQUENCE
  synthetic construct
MGSWGEFEHRLDPSTCVWLALGGSEAELAAFEKEIAAFESELQAYKGKGNPEVEKLRRGAAVIRHWLQAYRHN

SEQ ID NO: 196 - protein, 73 aa, ARTIFICIAL SEQUENCE
  synthetic construct
MGSWIEFAMRLEAIENRLTALGGSEAELAIFESMIAHFEELLQNYKGKGNPEVEALIHEAFAIHKELWAYRHN

SEQ ID NO: 197 - protein, 73 aa, ARTIFICIAL SEQUENCE
  synthetic construct
MGSWNEFYQRLEAIENRLQALGGSEAELAMFEVRIALFEDMLQGYKGKGNPEVEALKQEAIAILRELIAYRHN

SEQ ID NO: 198 - protein, 73 aa, ARTIFICIAL SEQUENCE
  synthetic construct
MGSWNEFYDRLRAIKKRLYALGGSEAELADFEEDIAQFEVDLQDYKGKGNPEVEALHREAHAITHELWAYRHN

SEQ ID NO: 199 - protein, 73 aa, ARTIFICIAL SEQUENCE
  synthetic construct
MGSWGEFKHRLALIKWYLEALGGSEAELAHFEDWIAVFEVQLQNYKGKGNPEVEALRKEAAAIRDELQAYRHN

SEQ ID NO: 200 - protein, 73 aa, ARTIFICIAL SEQUENCE
  synthetic construct
MGSWYEFKHRLAIIKWYLEALGGSEAELAKFEAWIAEFEMILQRYKGKGNPEVEALRKEAAAIRDELQAYRHN

SEQ ID NO: 201 - protein, 73 aa, ARTIFICIAL SEQUENCE
  synthetic construct
MGSWYEFKHRLAIIKWYLEALGGSEAELAHFEQYIADFEGTLQKYKGKGNPEVEALRKEAAAIRDELQAYRHN

SEQ ID NO: 202 - protein, 73 aa, ARTIFICIAL SEQUENCE
  synthetic construct
MGSWYNFKHRLAIIKWYLEALGGSEAELARFENFIANFETQLQLYKGKGNPEVEALRKEAAAIRDELQAYRHN

SEQ ID NO: 203 - protein, 73 aa, ARTIFICIAL SEQUENCE
  synthetic construct
MGSWFQFKHRLAIIKWQLEALGGSEAELAWFEQWIADFEHQLQHYKGKGNPEVEALRKEAAAIRDELQAYRHN

SEQ ID NO: 204 - protein, 73 aa, ARTIFICIAL SEQUENCE
  synthetic construct
MGSWYNFKHRLAIIKWFLEALGGSEAELAVFEVWIADFEHQLQEYKGKGNPEVEALRKEAAAIRDELQAYRHN

SEQ ID NO: 205 - protein, 73 aa, ARTIFICIAL SEQUENCE
  synthetic construct
MGSWDAFKHRLALIKWYLEALGGSEAELAHFEEYIAEFESNLQSYKGKGNPEVEALRKEAAAIRDELQAYRHN

SEQ ID NO: 206 - protein, 73 aa, ARTIFICIAL SEQUENCE
  synthetic construct
MGSWDGFKHRLALIKWYLEALGGSEAELANFENWIAEFEQRLQYYKGKGNPEVEALRKEAAAIRDELQAYRHN

SEQ ID NO: 207 - protein, 73 aa, ARTIFICIAL SEQUENCE
  synthetic construct
MGSWNGFKHRLAIIKWYLEALGGSEAELASFESYIAEFESGLQEYKGKGNPEVEALRKEAAAIRDELQAYRHN

SEQ ID NO: 208 - protein, 73 aa, ARTIFICIAL SEQUENCE
  synthetic construct
MGSWNSFKHRLALIKWYLEALGGSEAELATFEWYIASFESELQQYKGKGNPEVEALRKEAAAIRDELQAYRHN

SEQ ID NO: 209 - protein, 73 aa, ARTIFICIAL SEQUENCE
  synthetic construct
MGSWSDFKYRLAVIKFYLEALGGSEAELASFESFIAHFEDDLQKYKGKGNPEVEALRKEAAAIRDELQAYRHN

SEQ ID NO: 210 - protein, 73 aa, ARTIFICIAL SEQUENCE
  synthetic construct
MGSWSGFKYRLAVIKFYLEALGGSEAELASFELFIAKFEIDLQNYKGKGNPEVEALRKEAAAIRDELQAYRHN

SEQ ID NO: 211 - protein, 73 aa, ARTIFICIAL SEQUENCE
  synthetic construct
MGSWYGFKYRLAVIKWYLEALGGSEAELASFEKYIAHFEHDLQAYKGKGNPEVEALRKEAAAIRDELQAYRHN

SEQ ID NO: 212 - protein, 73 aa, ARTIFICIAL SEQUENCE
  synthetic construct
MGSWYGFKYRLAVIKWYLEALGGSEAELASFEKYIAQFEHDLQAYKGKGNPEVEALRKEAAAIRDELQAYRHN

SEQ ID NO: 213 - protein, 73 aa, ARTIFICIAL SEQUENCE
  synthetic construct
MGSWYGFKYRLALIKWYLEALGGSEAELASFETYIADFEDLLQAYKGKGNPEVEALRKEAAAIRDELQAYRHN

SEQ ID NO: 214 - protein, 73 aa, ARTIFICIAL SEQUENCE
  synthetic construct
MGSWSTFKYHLAVIKWYLEALGGSEAELASFEDYIAQFETDLQEYKGKGNPEVEALRKEAAAIRDELQAYRHN

SEQ ID NO: 215 - protein, 73 aa, ARTIFICIAL SEQUENCE
  synthetic construct
MGSWHEFKYRLALIKWYLEALGGSEAELATFEHHIAQFEWDLQKYKGKGNPEVEALRKEAAAIRDELQAYRHN

SEQ ID NO: 216 - protein, 73 aa, ARTIFICIAL SEQUENCE
  synthetic construct
MGSWNMFKYRLAHIKWYLEALGGSEAELATFEAYIADFEVDLQKYKGKGNPEVEALRKEAAAIRDELQAYRHN

SEQ ID NO: 217 - protein, 73 aa, ARTIFICIAL SEQUENCE
  synthetic construct
MGSWHGFKYRLAIIKWWLEALGGSEAELAFFEEWIASFERDLQIYKGKGNPEVEALRKEAAAIRDELQAYRHN

SEQ ID NO: 218 - protein, 73 aa, ARTIFICIAL SEQUENCE
  synthetic construct
MGSWHGFKYRLAVIKWYLEALGGSEAELAMFEGWIAQFEITLQQYKGKGNPEVEALRKEAAAIRDELQAYRHN

SEQ ID NO: 219 - protein, 73 aa, ARTIFICIAL SEQUENCE
  synthetic construct
MGSWQGFKYRLAVIKWMLEALGGSEAELAFFENWIAEFETKLQQYKGKGNPEVEALRKEAAAIRDELQAYRHN

SEQ ID NO: 220 - protein, 73 aa, ARTIFICIAL SEQUENCE
  synthetic construct
MGSWSGFKYRLAVIKWYLEALGGSEAELATFEEWIAEFETELQFYKGKGNPEVEALRKEAAAIRDELQAYRHN

SEQ ID NO: 221 - protein, 73 aa, ARTIFICIAL SEQUENCE
  synthetic construct
MGSWGYFKYRLAMIKWYLEALGGSEAELASFESWIAEFEGSLQAYKGKGNPEVEALRKEAAAIRDELQAYRHN

SEQ ID NO: 222 - protein, 73 aa, ARTIFICIAL SEQUENCE
  synthetic construct
MGSWHAFKYKLAMIKWYLEALGGSEAELAHFEEWIAEFEALLQEYKGKGNPEVEALRKEAAAIRDELQAYRHN

SEQ ID NO: 223 - protein, 73 aa, ARTIFICIAL SEQUENCE
  synthetic construct
MGSWQHFKYRLAIIKWYLEALGGSEAELAFFESFIAKFEHDLQKYKGKGNPEVEALRKEAAAIRDELQAYRHN

SEQ ID NO: 224 - protein, 73 aa, ARTIFICIAL SEQUENCE
  synthetic construct
MGSWNDFKYRLAIIKYYLEALGGSEAELAHFESYIASFEHDLQNYKGKGNPEVEALRKEAAAIRDELQAYRHN

SEQ ID NO: 225 - protein, 73 aa, ARTIFICIAL SEQUENCE
  synthetic construct
MGSWGAFKYRLAIIKFYLEALGGSEAELARFEEFIANFEHDLQNYKGKGNPEVEALRKEAAAIRDELQAYRHN

SEQ ID NO: 226 - protein, 73 aa, ARTIFICIAL SEQUENCE
  synthetic construct
MGSWYNFKYRLAIIKFYLEALGGSEAELAQFEIWIAEFEHDLQGYKGKGNPEVEALRKEAAAIRDELQAYRHN

SEQ ID NO: 227 - protein, 73 aa, ARTIFICIAL SEQUENCE
  synthetic construct
MGSWEQFKYRLAIIKYMLEALGGSEAELAWFESWIANFESDLQHYKGKGNPEVEALRKEAAAIRDELQAYRHN

SEQ ID NO: 228 - protein, 73 aa, ARTIFICIAL SEQUENCE
  synthetic construct
MGSWQQFKYRLAIIKYYLEALGGSEAELAGFETYIAKFEEVLQSYKGKGNPEVEALRKEAAAIRDELQAYRHN

SEQ ID NO: 229 - protein, 73 aa, ARTIFICIAL SEQUENCE
  synthetic construct
MGSWAGFKYRLAVIKYYLEALGGSEAELAHFEQWIAHFEGMLQDYKGKGNPEVEALRKEAAAIRDELQAYRHN

SEQ ID NO: 230 - protein, 73 aa, ARTIFICIAL SEQUENCE
  synthetic construct
MGSWTAFKYRLAIIKFYLEALGGSEAELAHFESYIAHFEDMLQHYKGKGNPEVEALRKEAAAIRDELQAYRHN

SEQ ID NO: 231 - protein, 73 aa, ARTIFICIAL SEQUENCE
  synthetic construct
MGSWAHFKYRLAIIKFWLEALGGSEAELANFEEYIAEFESTLQVYKGKGNPEVEALRKEAAAIRDELQAYRHN

SEQ ID NO: 232 - protein, 73 aa, ARTIFICIAL SEQUENCE
  synthetic construct
MGSWANFKYRLALIKWHLEALGGSEAELASFEIWIADFEESLQWYKGKGNPEVEALRKEAAAIRDELQAYRHN

SEQ ID NO: 233 - protein, 73 aa, ARTIFICIAL SEQUENCE
  synthetic construct
MGSWATFKYRLALIKWHLEALGGSEAELADFEEYIAGFEEGLQKYKGKGNPEVEALRKEAAAIRDELQAYRHN

SEQ ID NO: 234 - protein, 73 aa, ARTIFICIAL SEQUENCE
  synthetic construct
MGSWTHFKYRLALIKWWLEALGGSEAELAGFEVHIADFEAQLQMYKGKGNPEVEALRKEAAAIRDELQAYRHN

SEQ ID NO: 235 - protein, 73 aa, ARTIFICIAL SEQUENCE
  synthetic construct
MGSWNTFKYHLAVIKFMLEALGGSEAELAFFEQWIAEFEVTLQSYKGKGNPEVEALRKEAAAIRDELQAYRHN

SEQ ID NO: 236 - protein, 73 aa, ARTIFICIAL SEQUENCE
  synthetic construct
MGSWTQFKYHLAVIKWYLEALGGSEAELAGFEQWIAEFEKTLQEYKGKGNPEVEALRKEAAAIRDELQAYRHN

SEQ ID NO: 237 - protein, 73 aa, ARTIFICIAL SEQUENCE
  synthetic construct
MGSWNQFKYRLAVIKFYLEALGGSEAELAHFETWIAAFEEQLQFYKGKGNPEVEALRKEAAAIRDELQAYRHN

SEQ ID NO: 238 - protein, 73 aa, ARTIFICIAL SEQUENCE
  synthetic construct
MGSWNEFKYHLAVIKFYLEALGGSEAELAHFETWIAEFEYELQKYKGKGNPEVEALRKEAAAIRDELQAYRHN

SEQ ID NO: 239 - protein, 73 aa, ARTIFICIAL SEQUENCE
  synthetic construct
MGSWVQFKYHLAVIKFYLEALGGSEAELAHFETWIAEFEVALQGYKGKGNPEVEALRKEAAAIRDELQAYRHN

SEQ ID NO: 240 - protein, 73 aa, ARTIFICIAL SEQUENCE
  synthetic construct
MGSWVDFKYHLAVIKFWLEALGGSEAELANFETWIANFEQELQMYKGKGNPEVEALRKEAAAIRDELQAYRHN

SEQ ID NO: 241 - protein, 73 aa, ARTIFICIAL SEQUENCE
  synthetic construct
MGSWVDFKYHLAVIKWYLEALGGSEAELADFENWIAHFESILQQYKGKGNPEVEALRKEAAAIRDELQAYRHN

SEQ ID NO: 242 - protein, 73 aa, ARTIFICIAL SEQUENCE
  synthetic construct
MGSWVEFKYHLAVIKFTLEALGGSEAELADFEEEIARFEMILQQYKGKGNPEVEALRKEAAAIRDELQAYRHN

SEQ ID NO: 243 - protein, 73 aa, ARTIFICIAL SEQUENCE
  synthetic construct
MGSWSHFKYHLALIKWYLEALGGSEAELAKFEFWIAEFEHNLQMYKGKGNPEVEALRKEAAAIRDELQAYRHN

SEQ ID NO: 244 - protein, 73 aa, ARTIFICIAL SEQUENCE
  synthetic construct
MGSWYHFKYHLALIKWYLEALGGSEAELAHFEHWIAEFEWTLQQYKGKGNPEVEALRKEAAAIRDELQAYRHN

SEQ ID NO: 245 - protein, 73 aa, ARTIFICIAL SEQUENCE
  synthetic construct
MGSWQGFKYHLALIKFYLEALGGSEAELAHFEHWLAEFEHDLQTYKGKGNPEVEALRKEAAAIRDELQAYRHN

SEQ ID NO: 246 - protein, 73 aa, ARTIFICIAL SEQUENCE
  synthetic construct
MGSWLSFKHHLALIKWYLEALGGSEAELASFEAWIALFEHQLQQYKGKGNPEVEALRKEAAAIRDELQAYRHN

SEQ ID NO: 247 - protein, 73 aa, ARTIFICIAL SEQUENCE
  synthetic construct
MGSWSEFKYKLALIKWYLEALGGSEAELAHFEGWIANFETTLQKYKGKGNPEVEALRKEAAAIRDELQAYRHN

SEQ ID NO: 248 - protein, 73 aa, ARTIFICIAL SEQUENCE
  synthetic construct
MGSWIEFKYKLAIIKFYLEALGGSEAELAHFEHWIADFEFVLQQYKGKGNPEVEALRKEAAAIRDELQAYRHN

SEQ ID NO: 249 - protein, 73 aa, ARTIFICIAL SEQUENCE
  synthetic construct
MGSWQNFKYHLAMIKWYLEALGGSEAELANFEEFIAQFEINLQHYKGKGNPEVEALRKEAAAIRDELQAYRHN

SEQ ID NO: 250 - protein, 73 aa, ARTIFICIAL SEQUENCE
  synthetic construct
MGSWYNFKYHLAIIKWWLEALGGSEAELADFEHYIADFERNLQEYKGKGNPEVEALRKEAAAIRDELQAYRHN

SEQ ID NO: 251 - protein, 73 aa, ARTIFICIAL SEQUENCE
  synthetic construct
MGSWYQFKYHLAIIKWYLEALGGSEAELAGFENYIATFEQELQQYKGKGNPEVEALRKEAAAIRDELQAYRHN

SEQ ID NO: 252 - protein, 73 aa, ARTIFICIAL SEQUENCE
  synthetic construct
MGSWSHFKYHLAIIKFYLEALGGSEAELAGFEIWIAKFEDELQMYKGKGNPEVEALRKEAAAIRDELQAYRHN

SEQ ID NO: 253 - protein, 73 aa, ARTIFICIAL SEQUENCE
  synthetic construct
MGSWVGFKAHLAIIKWYLEALGGSEAELAGFEIFIADFEALLQMYKGKGNPEVEALRKEAAAIRDELQAYRHN

SEQ ID NO: 254 - protein, 73 aa, ARTIFICIAL SEQUENCE
  synthetic construct
MGSWVNFKYKLAIIKYMLEALGGSEAELAFFEDWIAEFERTLQQYKGKGNPEVEALRKEAAAIRDELQAYRHN

SEQ ID NO: 255 - protein, 73 aa, ARTIFICIAL SEQUENCE
  synthetic construct
MGSWSNFKYRLAVIKYMLEALGGSEAELAFFEDWIADFELHLQVYKGKGNPEVEALRKEAAAIRDELQAYRHN

SEQ ID NO: 256 - protein, 73 aa, ARTIFICIAL SEQUENCE
  synthetic construct
MGSWTNFKYKLAVIKFMLEALGGSEAELAFFEDWIAGFEIDLQNYKGKGNPEVEALRKEAAAIRDELQAYRHN

SEQ ID NO: 257 - protein, 73 aa, ARTIFICIAL SEQUENCE
  synthetic construct
MGSWTGFKYRLAIIKFMLEALGGSEAELAFFEQWIADFENELQYYKGKGNPEVEALRKEAAAIRDELQAYRHN

SEQ ID NO: 258 - protein, 73 aa, ARTIFICIAL SEQUENCE
  synthetic construct
MGSWHNFKYRLAIIKFMLEALGGSEAELAWFENWIADFEDSLQDYKGKGNPEVEALRKEAAAIRDELQAYRHN

SEQ ID NO: 259 - protein, 73 aa, ARTIFICIAL SEQUENCE
  synthetic construct
MGSWFAFKHRLAVIKYMLEALGGSEAELAFFEHWIAQFEHDLQQYKGKGNPEVEALRKEAAAIRDELQAYRHN

SEQ ID NO: 260 - protein, 73 aa, ARTIFICIAL SEQUENCE
  synthetic construct
MGSWYEFKHRLAVIKYMLEALGGSEAELAFFENWIAQFEHELQTYKGKGNPEVEALRKEAAAIRDELQAYRHN

SEQ ID NO: 261 - protein, 73 aa, ARTIFICIAL SEQUENCE
  synthetic construct
MGSWYKFKHKLAVIKYMLEALGGSEAELAWFEEWIAEFEVTLQDYKGKGNPEVEALRKEAAAIRDELQAYRHN

SEQ ID NO: 262 - protein, 73 aa, ARTIFICIAL SEQUENCE
  synthetic construct
MGSWFYFKQKLAFIKWYLEALGGSEAELANFEIYIAEFEVMLQQYKGKGNPEVEALRKEAAAIRDELQAYRHN

SEQ ID NO: 263 - protein, 73 aa, ARTIFICIAL SEQUENCE
  synthetic construct
MGSWFSFKHHLAVIKWNLEALGGSEAELASFEEQIAEFESVLQAYKGKGNPEVEALRKEAAAIRDELQAYRHN

SEQ ID NO: 264 - protein, 73 aa, ARTIFICIAL SEQUENCE
  synthetic construct
MGSWGNFKYRLAIIKFHLEALGSSEAELATFEAWIANFESMLQNYKGKGNPEVEALRKEAAAIRDELQAYRHN

SEQ ID NO: 265 - protein, 73 aa, ARTIFICIAL SEQUENCE
  synthetic construct
MGSWSYFKYGLAIIKIRLEALGGSEAELADFERWIAAFEHDLQYYKGKGNPEVEALRKEAAAIRDELQAYRHN

SEQ ID NO: 266 - protein, 73 aa, ARTIFICIAL SEQUENCE
  synthetic construct
MGSWSYFKFGLAHIKLRLEALGGSEAELADFEQWIASFEEQLQTYKGKGNPEVEALRKEAAAIRDELQAYRHN

SEQ ID NO: 267 - protein, 73 aa, ARTIFICIAL SEQUENCE
  synthetic construct
MGSWSYFKWGLAHIKLRLEALGGSEAELADFEFWIAEFEGLLQDYKGKGNPEVEALRKEAAAIRDELQAYRHN

SEQ ID NO: 268 - protein, 73 aa, ARTIFICIAL SEQUENCE
  synthetic construct
MGSWIYFKYGLAHIKTRLEALGGSEAELADFEQWIAEFEKMLQDYKGKGNPEVEALRKEAAAIRDELQAYRHN

SEQ ID NO: 269 - protein, 73 aa, ARTIFICIAL SEQUENCE
  synthetic construct
MGSWGYFKYGLATIKHRLEALGGSEAELADFELWIAKFEEQLQVYKGKGNPEVEALRKEAAAIRDELQAYRHN

SEQ ID NO: 270 - protein, 73 aa, ARTIFICIAL SEQUENCE
  synthetic construct
MGSWEYFKYGLATIKMHLEALGGSEAELADFEHWIAHFEHQLQMYKGKGNPEVEALRKEAAAIRDELQAYRHN

SEQ ID NO: 271 - protein, 73 aa, ARTIFICIAL SEQUENCE
  synthetic construct
MGSWSYFKYGLATIKEKLEALGGSEAELADFETWIAMFEKQLQEYKGKGNPEVEALRKEAAAIRDELQAYRHN

SEQ ID NO: 272 - protein, 73 aa, ARTIFICIAL SEQUENCE
  synthetic construct
MGSWHYFKNGLAIIKEKLEALGGSEAELADFEIWIAMFEMELQEYKGKGNPEVEALRKEAAAIRDELQAYRHN

SEQ ID NO: 273 - protein, 73 aa, ARTIFICIAL SEQUENCE
  synthetic construct
MGSWQYFKYGLAIIKIKLEALGGSEAELADFEAWIATFEKQLQHYKGKGNPEVEALRKEAAAIRDELQAYRHN

SEQ ID NO: 274 - protein, 73 aa, ARTIFICIAL SEQUENCE
  synthetic construct
MGSWVYFKHGLAVIKMRLEALGGSEAELADFETWIAQFEMTLQEYKGKGNPEVEALRKEAAAIRDELQAYRHN

SEQ ID NO: 275 - protein, 73 aa, ARTIFICIAL SEQUENCE
  synthetic construct
MGSWVYFKYGLAVIKEKLEALGGSEAELADFETWIAEFEFGLQQYKGKGNPEVEALRKEAAAIRDELQAYRHN

SEQ ID NO: 276 - protein, 73 aa, ARTIFICIAL SEQUENCE
  synthetic construct
MGSWYYFKYGLAVIKGKLEALGGSEAELADFETWIAKFENHLQSYKGKGNPEVEALRKEAAAIRDELQAYRHN

SEQ ID NO: 277 - protein, 73 aa, ARTIFICIAL SEQUENCE
  synthetic construct
MGSWTYFKYGLALIKYRLEALGGSEAELADFEEWIAQFEVSLQHYKGKGNPEVEALRKEAAAIRDELQAYRHN

SEQ ID NO: 278 - protein, 73 aa, ARTIFICIAL SEQUENCE
  synthetic construct
MGSWDYFKYGLALIKIKLEALGGSEAELADFEVWIAQFEMALQVYKGKGNPEVEALRKEAAAIRDELQAYRHN

SEQ ID NO: 279 - protein, 73 aa, ARTIFICIAL SEQUENCE
  synthetic construct
MGSWTYFKFGLAHIKDSLEALGGSEAELADFEQWIAMFEQDLQVYKGKGNPEVEALRKEAAAIRDELQAYRHN

SEQ ID NO: 280 - protein, 73 aa, ARTIFICIAL SEQUENCE
  synthetic construct
MGSWGYFKHGLAHIKSSLEALGGSEAELADFEVWIAAFENELQEYKGKGNPEVEALRKEAAAIRDELQAYRHN

SEQ ID NO: 281 - protein, 73 aa, ARTIFICIAL SEQUENCE
  synthetic construct
MGSWGYFKTGLAIIKAQLEALGGSEAELADFELWIAQFEETLQFYKGKGNPEVEALRKEAAAIRDELQAYRHN

SEQ ID NO: 282 - protein, 73 aa, ARTIFICIAL SEQUENCE
  synthetic construct
MGSWAYFKYGLAVIKLHLEALGGSEAELADFERYIAEFEYELQAYKGKGNPEVEALRKEAAAIRDELQAYRHN

SEQ ID NO: 283 - protein, 73 aa, ARTIFICIAL SEQUENCE
  synthetic construct
MGSWLDFKEGLADIKRSLEALGGSEAELADFEGVIALFEWKLQTYKGKGNPEVEALRKEAAAIRDELQAYRHN

SEQ ID NO: 284 - protein, 73 aa, ARTIFICIAL SEQUENCE
  synthetic construct
MGSWEVFKHELAVIKDYLEALGGSEAELAHFEWGIAWFEGFLQDYKGKGNPEVEALRKEAAAIRDELQAYRHN

SEQ ID NO: 285 - protein, 73 aa, ARTIFICIAL SEQUENCE
  synthetic construct
MGSWIVFKQSLAWIKEHLEALGGSEAELAEFEFYIANFEHTLQNYKGKGNPEVEALRKEAAAIRDELQAYRHN

SEQ ID NO: 286 - protein, 73 aa, ARTIFICIAL SEQUENCE
  synthetic construct
MGSWIYFKDSLAYIKKYLEALGGSEAELATFEYYIANFEHELQYYKGKGNPEVEALRKEAAAIRDELQAYRHN

SEQ ID NO: 287 - protein, 73 aa, ARTIFICIAL SEQUENCE
  synthetic construct
MGSWDHFKYNLAWIKKYLEALGGSEAELATFEWYIANFEKRLQDYKGKGNPEVEALRKEAAAIRDELQAYRHN

SEQ ID NO: 288 - protein, 73 aa, ARTIFICIAL SEQUENCE
  synthetic construct
MGSWFTFKQNLAWIKLHLEALGGSEAELARFEYYIADFENKLQLYKGKGNPEVEALRKEAAAIRDELQAYRHN

SEQ ID NO: 289 - protein, 73 aa, ARTIFICIAL SEQUENCE
  synthetic construct
MGSWREFKYGLAHIKRVLEALGGSEAELAVFEYYIAKFEQELQEYKGKGNPEVEALRKEAAAIRDELQAYRHN

SEQ ID NO: 290 - protein, 73 aa, ARTIFICIAL SEQUENCE
  synthetic construct
MGSWIQFKYGLAHIKRTLEALGGSEAELAVFEWYIADFEQQLQGYKGKGNPEVEALRKEAAAIRDELQAYRHN

SEQ ID NO: 291 - protein, 73 aa, ARTIFICIAL SEQUENCE
  synthetic construct
MGSWVEFKHNLAWIKVTLEALGGSEAELAVFEYYIAQFEEQLQEYKGKGNPEVEALRKEAAAIRDELQAYRHN

SEQ ID NO: 292 - protein, 73 aa, ARTIFICIAL SEQUENCE
  synthetic construct
MGSWISFKDNLAMIKEFLEALGGSEAELAVFEWYIATFEVELQDYKGKGNPEVEALRKEAAAIRDELQAYRHN

SEQ ID NO: 293 - protein, 73 aa, ARTIFICIAL SEQUENCE
  synthetic construct
MGSWHIFKDNLATIKAFLEALGGSEAELAVFEWYIAKFEEELQGYKGKGNPEVEALRKEAAAIRDELQAYRHN

SEQ ID NO: 294 - protein, 73 aa, ARTIFICIAL SEQUENCE
  synthetic construct
MGSWTSFKHGLAGIKRVLEALGGSEAELATFEWYIAQFERHLQAYKGKGNPEVEALRKEAAAIRDELQAYRHN

SEQ ID NO: 295 - protein, 73 aa, ARTIFICIAL SEQUENCE
  synthetic construct
MGSWQSFKHALADIKINLEALGGSEAELAQFEYAIAVFEYRLQAYKGKGNPEVEALRKEAAAIRDELQAYRHN

SEQ ID NO: 296 - protein, 73 aa, ARTIFICIAL SEQUENCE
  synthetic construct
MGSWHTFKEALAQIKGELEALGGSEAELASFEYAIAVFEYRLQMYKGKGNPEVEALRKEAAAIRDELQAYRHN

SEQ ID NO: 297 - protein, 73 aa, ARTIFICIAL SEQUENCE
  synthetic construct
MGSWTDFKTSLADIKAELEALGGSEAELAKFEYYIAIFEYRLQEYKGKGNPEVEALRKEAAAIRDELQAYRHN

SEQ ID NO: 298 - protein, 73 aa, ARTIFICIAL SEQUENCE
  synthetic construct
MGSWTNFKEGLAEIKRDLEALGGSEAELARFEYVIAVFEFRLQNYKGKGNPEVEALRKEAAAIRDELQAYRHN

SEQ ID NO: 299 - protein, 73 aa, ARTIFICIAL SEQUENCE
  synthetic construct
MGSWHTFKDGLAEIKSELEALGGSEAELAMFEYVIAIFEYRLQNYKGKGNPEVEALRKEAAAIRDELQAYRHN

SEQ ID NO: 300 - protein, 73 aa, ARTIFICIAL SEQUENCE
  synthetic construct
MGSWQFFKEHLASIKFWLEALGGSEAELAFFEDAIADFEYHLQNYKGKGNPEVEALRKEAAAIRDELQAYRHN

SEQ ID NO: 301 - protein, 73 aa, ARTIFICIAL SEQUENCE
  synthetic construct
MGSWTYFKEHLASIKFWLEALGGSEAELAFFEDAIAEFEKDLQYYKGKGNPEVEALRKEAAAIRDELQAYRHN

SEQ ID NO: 302 - protein, 73 aa, ARTIFICIAL SEQUENCE
  synthetic construct
MGSWIIFKGYLAHIKHHLEALGGSEAELADFEFYIAIFEMELQKYKGKGNPEVEALRKEAAAIRDELQAYRHN

SEQ ID NO: 303 - protein, 73 aa, ARTIFICIAL SEQUENCE
  synthetic construct
MGSWYLFQSHLAHIKHHLEALGGSEAELAWFEFTIAGFEQELQHYKGKGNPEVEALRKEAAAIRDELQAYRHN

SEQ ID NO: 304 - protein, 73 aa, ARTIFICIAL SEQUENCE
  synthetic construct
MGSWYSFKWTLARIKLELEALGGSEAELAYFENVIAHFEMELQSYKGKGNPEVEALRKEAAAIRDELQAYRHN

SEQ ID NO: 305 - protein, 73 aa, ARTIFICIAL SEQUENCE
  synthetic construct
MGSWTTLKWRLAHIKQHLEALGGSEAELALFEYDIAHFEELLQYYKGKGNPEVEALRKEAAAIRDELQAYRHN

SEQ ID NO: 306 - protein, 73 aa, ARTIFICIAL SEQUENCE
  synthetic construct
MGSWYGFKWYLATIKKHLEALGGSEAELALFETEIATFELWLQDYKGKGNPEVEALRKEAAAIRDELQAYRHN

SEQ ID NO: 307 - protein, 73 aa, ARTIFICIAL SEQUENCE
  synthetic construct
MGSWIEFNMRVLAIEDRLWALGGSEAELAAFEKEIAAFESELQAYKGKGNPEVESLRYEACLDPWSSAAYRHN

SEQ ID NO: 308 - protein, 73 aa, ARTIFICIAL SEQUENCE
  synthetic construct
MGSWIEFHERLWAIEDRLWALGGSEAELAAFEKEIAAFESELQAYKGKGNPEVESLREMAASIRHGLQAYRHN

SEQ ID NO: 309 - protein, 73 aa, ARTIFICIAL SEQUENCE
  synthetic construct
MGSWFEFYERLWAIDDRLWALGGSEAELAAFEKEIAAFESELQAYKGKGNPEVEWLREEAASIRSSLQAYRHN

SEQ ID NO: 310 - protein, 73 aa, ARTIFICIAL SEQUENCE
  synthetic construct
MGSWFEFWDRLEAIDDRLFALGGSEAELAAFEKEIAAFESELQAYKGKGNPEVESLRYNAAEIRKELQAYRHN

SEQ ID NO: 311 - protein, 73 aa, ARTIFICIAL SEQUENCE
  synthetic construct
MGSWHEFWSRLDAIDDRLFALGGSEAELAAFEKEIAAFESELQAYKGKGNPEVEYLRGAAADIRAELQAYRHN

SEQ ID NO: 312 - protein, 73 aa, ARTIFICIAL SEQUENCE
  synthetic construct
MGSWYEFWIRLEAIDDRLFALGGSEAELAAFEKEIAAFESELQAYKGKGNPEVDILRDFAADIRTELQAYRHN

SEQ ID NO: 313 - protein, 73 aa, ARTIFICIAL SEQUENCE
  synthetic construct
MGSWHEFWDRLEAIDDRLYALGGSEAELAAFEKEIAAFESELQAYKGKGNPEVEFLREEAAYIRELLQAYRHN

SEQ ID NO: 314 - protein, 73 aa, ARTIFICIAL SEQUENCE
  synthetic construct
MGSWEEFWDRLFAIDDRLWALGGSEAELAAFEKEIAAFESELQAYKGKGNPEVETLRNEAAEIRMALQAYRHN

SEQ ID NO: 315 - protein, 73 aa, ARTIFICIAL SEQUENCE
  synthetic construct
MGSWWEFDDRLFAIDTRLMALGGSEAELAAFEKEIAAFESELQAYKGKGNPEVESLREWAATIRMELQAYRHN

SEQ ID NO: 316 - protein, 73 aa, ARTIFICIAL SEQUENCE
  synthetic construct
MGSWTEFHDRLEAIDDRLWALGGSEAELAAFEKEIAAFESELQAYKGKGNPEVEYLREEAAQIRWELQAYRHN

SEQ ID NO: 317 - protein, 73 aa, ARTIFICIAL SEQUENCE
  synthetic construct
MGSWAEFEDRLWAIEDRLWALGGSEAELAAFEKEIAAFESELQAYKGKGNPEVEYLREEAAAIRFELQAYRHN

SEQ ID NO: 318 - protein, 73 aa, ARTIFICIAL SEQUENCE
  synthetic construct
MGSWVEFWFRLEAIDSRLWALGGSEAELAAFEKEIAAFESELQAYKGKGNPEVEWLREEAAAIREDLQAYRHN

SEQ ID NO: 319 - protein, 73 aa, ARTIFICIAL SEQUENCE
  synthetic construct
MGSWVEFWQRLEAIESRLWALGGSEAELAAFEKEIAAFESELQAYKGKGNPEVEFLREEAAEIRWELQAYRHN

SEQ ID NO: 320 - protein, 73 aa, ARTIFICIAL SEQUENCE
  synthetic construct
MGSWSEFWQRLEAIEDRLWALGGSEAELAAFEKEIAAFESELQAYKGKGNPEVEWLRENAAMIRDELQAYRHN

SEQ ID NO: 321 - protein, 73 aa, ARTIFICIAL SEQUENCE
  synthetic construct
MGSWSEFITRLEAIDDRLWALGGSEAELAAFEKEIAAFESELQAYKGKGNPEVEILREEAAEIRQHLQAYRHN

SEQ ID NO: 322 - protein, 73 aa, ARTIFICIAL SEQUENCE
  synthetic construct
MGSWYEFETRLEAIYDRLWALGGSEAELAAFEKEIAAFESELQAYKGKGNPEVELLRVEAAEIREDLQAYRHN

SEQ ID NO: 323 - protein, 73 aa, ARTIFICIAL SEQUENCE
  synthetic construct
MGSWTEFYYRLEAIEDRLWALGGSEAELAAFEKEIAAFESELQAYKGKGNPEVEFLRVEAANIRDMLQAYRHN

SEQ ID NO: 324 - protein, 73 aa, ARTIFICIAL SEQUENCE
  synthetic construct
MGSWYEFVIRLEAIEDRLWALGGSEAELAAFEKEIAAFESELQAYKGKGNPEVEVLRWYAADIRHELQAYRHN

SEQ ID NO: 325 - protein, 73 aa, ARTIFICIAL SEQUENCE
  synthetic construct
MGSWTEFSIRLEAIYDRLVALGGSEAELAAFEKEIAAFESELQAYKGKGNPEVEVLRTYAANIRHELQAYRHN

SEQ ID NO: 326 - protein, 73 aa, ARTIFICIAL SEQUENCE
  synthetic construct
MGSWTEFSIRLEAIYDRLVALGGSEAELAAFEKEIAAFESELQAYKGKGNPEVEVLRTYAAFIRHELQAYRHN

SEQ ID NO: 327 - protein, 73 aa, ARTIFICIAL SEQUENCE
  synthetic construct
MGSWTEFVWRLEAIWDRLDALGGSEAELAAFEKEIAAFESELQAYKGKGNPEVEVLREDAAVIRHFLQAYRHN

SEQ ID NO: 328 - protein, 73 aa, ARTIFICIAL SEQUENCE
  synthetic construct
MGSWVEFHERLEAIEDRLMALGGSEAELAAFEKEIAAFESELQAYKGKGNPEVEYLREDAAFIRQLLQAYRHN

SEQ ID NO: 329 - protein, 73 aa, ARTIFICIAL SEQUENCE
  synthetic construct
MGSWVEFHDRLEAIEDRLYALGGSEAELAAFEKEIAAFESELQAYKGKGNPEVEWLREDAAYIRSILQAYRHN

SEQ ID NO: 330 - protein, 73 aa, ARTIFICIAL SEQUENCE
  synthetic construct
MGSWIEFYDRLEAIYDRLDALGGSEAELAAFEKEIAAFESELQAYKGKGNPEVEWLREDAAFIRSWLQAYRHN

SEQ ID NO: 331 - protein, 73 aa, ARTIFICIAL SEQUENCE
  synthetic construct
MGSWVEFDQRLEAIYDRLYALGGSEAELAAFEKEIAAFESELQAYKGKGNPEVEWLREDAAQIRKWLQAYRHN

SEQ ID NO: 332 - protein, 73 aa, ARTIFICIAL SEQUENCE
  synthetic construct
MGSWVEFHDRLEAIEDRLLALGGSEAELAAFEKEIAAFESELQAYKGKGNPEVEDLREYAAGIRWFLQAYRHN

SEQ ID NO: 333 - protein, 73 aa, ARTIFICIAL SEQUENCE
  synthetic construct
MGSWEEFAQRLYAIEWRLYALGGSEAELAAFEKEIAAFESELQAYKGKGNPEVEVLRYVAAQIRYHLQAYRHN

SEQ ID NO: 334 - protein, 73 aa, ARTIFICIAL SEQUENCE
  synthetic construct
MGSWDEFAWRLDVIFARLGALGGSEAELAAFEKEIAAFESELQAYKGKGNPEVEELRKNAAQIRDGLQAYRHN

SEQ ID NO: 335 - protein, 73 aa, ARTIFICIAL SEQUENCE
  synthetic construct
MGSWDEFYYRLEAIEMRLGALGGSEAELAAFEKEIAAFESELQAYKGKGNPEVEELRHYAAQIRHMLQAYRHN

SEQ ID NO: 336 - protein, 73 aa, ARTIFICIAL SEQUENCE
  synthetic construct
MGSWEEFYDRLEAIYNRLGALGGSEAELAAFEKEIAAFESELQAYKGKGNPEVEVLREYAADIREMLQAYRHN

SEQ ID NO: 337 - protein, 73 aa, ARTIFICIAL SEQUENCE
  synthetic construct
MGSWDEFGRRLYAIEWQLYALGGEEAELAAFEKEIAAFESELQAYKGKGNPEVEALRKEAAVIRENLQAYRHN

SEQ ID NO: 338 - protein, 73 aa, ARTIFICIAL SEQUENCE
  synthetic construct
MGSWDEFGRRLYAIEWQLYALGGTEAELAAFEKEIAAFESELQAYKGKGNPEVEALRKEAAVIRENLQAYRHN

SEQ ID NO: 339 - protein, 73 aa, ARTIFICIAL SEQUENCE
  synthetic construct
MGSWDEFGRRLYAIETQLYALGGEEAELAAFEKEIAAFESELQAYKGKGNPEVEKLREIAAVIRENLQAYRHN

SEQ ID NO: 340 - protein, 73 aa, ARTIFICIAL SEQUENCE
  synthetic construct
MGSWDEFGRRLYAIEWQLYALGGEEAELAAFEKEIAAFESELQAYKGKGNPEVEKLREIAAVIRENLQAYRHN

SEQ ID NO: 341 - protein, 73 aa, ARTIFICIAL SEQUENCE
  synthetic construct
MGSWDEFGRRLYAIKWQLYALGGEEAELAAFEKEIAAFESELQAYKGKGNPEVEKLREIAAVIRENLQAYRHN

SEQ ID NO: 342 - protein, 73 aa, ARTIFICIAL SEQUENCE
  synthetic construct
MGSWDEFGRRLYAIEWQLYALGGEEAELAAFEKEIAAFESELQAYKGKGNPEVEKLRKIAAVIRENLQAYRHN

SEQ ID NO: 343 - protein, 73 aa, ARTIFICIAL SEQUENCE
  synthetic construct
MGSWDEFGRRLYAIEWQLYALGGGEAELAAFEKEIAAFESELQAYKGKGNPEVEKLREIAAVIRENLQAYRHN

SEQ ID NO: 344 - protein, 73 aa, ARTIFICIAL SEQUENCE
  synthetic construct
MGSWDEFGRRLYAIEWQLYALGGTEAELAAFEKEIAAFESELQAYKGKGNPEVEKLREIAAVIRENLQAYRHN

SEQ ID NO: 345 - protein, 73 aa, ARTIFICIAL SEQUENCE
  synthetic construct
MGSWDEFGRRLYAIEWQLYALGGGEAELAAFEKEIAAFESELQAYKGKGNPEVEKLREIAAVIRSNLQAYRHN

SEQ ID NO: 346 - protein, 73 aa, ARTIFICIAL SEQUENCE
  synthetic construct
MGSWDEFGRRLYAIEWQLYALGGTEAELAAFEKEIAAFESELQAYKGKGNPEVEKLREIAAVIRSNLQAYRHN

SEQ ID NO: 347 - protein, 73 aa, ARTIFICIAL SEQUENCE
  synthetic construct
MGSWDEFGRRLYAIEWQLYALGGEEAELAAFEKEIAAFESELQAYKGKGNPEVEKLREIAAVIRSNLQAYRHN

SEQ ID NO: 348 - protein, 73 aa, ARTIFICIAL SEQUENCE
  synthetic construct
MGSWDEFGRRLAAIEWQLYALGGEEAELAAFEKEIAAFESELQAYKGKGNPEVEKLREIAAVIRENLQAYRHN

SEQ ID NO: 349 - protein, 73 aa, ARTIFICIAL SEQUENCE
  synthetic construct
MGSWDEFGRRLYAIEWQLYALGGEEAELAAFEKEIAAFESELQAYKGKGNPEVEALREIAAVIRENLQAYRHN

SEQ ID NO: 350 - protein, 73 aa, ARTIFICIAL SEQUENCE
  synthetic construct
MGSWDEFGRRLYAIEWQLYALGGEEAELAAFEKEIAAFESELQAYKGKGNPEVEKLREEAAVIRENLQAYRHN

SEQ ID NO: 351 - protein, 73 aa, ARTIFICIAL SEQUENCE
  synthetic construct
MGSWDEFGRRLYAIEWRLYALGGSEAELAAFEKEIAAFESELQAYKGKGSPEVEKLREIAAVIRSNLQAYRHN

SEQ ID NO: 352 - protein, 73 aa, ARTIFICIAL SEQUENCE
  synthetic construct
MGSWDEFGRRLYAIEWRLYALGGSEAELAAFEKEIAAFESELQAYKGKGNPEVEKLREIAAVIRSNLQAYRHN

SEQ ID NO: 353 - protein, 73 aa, ARTIFICIAL SEQUENCE
  synthetic construct
MGSWDEFGRRLYAIEWRLYALGGEEAELAAFEKEIAAFESELQAYKGKGNPEVEKLREIAAVIRSNLQAYRHN

SEQ ID NO: 354 - protein, 73 aa, ARTIFICIAL SEQUENCE
  synthetic construct
MGSWDEFGRRLYAIEWQLYALGGSEAELAAFEKEIAAFESELQAYKGKGNPEVEKLREIAAVIRSNLQAYRHN

SEQ ID NO: 355 - protein, 73 aa, ARTIFICIAL SEQUENCE
  synthetic construct
MGSWDEFSRRLYAIEWRLYALGGSEAELAAFEKEIAAFESELQAYKGKGNPEVEKLREIAAVIRSNLQAYRHN

SEQ ID NO: 356 - protein, 73 aa, ARTIFICIAL SEQUENCE
  synthetic construct
MGSWDEFGRRLYAIEWRLYALGGSEAELAAFEKEIAAFESELQAYKGKGNPEVEKLREIAAVIRENLQAYRHN

SEQ ID NO: 357 - protein, 73 aa, ARTIFICIAL SEQUENCE
  synthetic construct
MGSWDEFGRRLAAIKTQLAALGGEEAELAAFEKEIAAFESELQAYKGKGNPEVEKLREIAAVIRENLQAYRHN

SEQ ID NO: 358 - protein, 73 aa, ARTIFICIAL SEQUENCE
  synthetic construct
MGSWDEFGRRLAAIKTQLAALGGTEAELAAFEKEIAAFESELQAYKGKGNPEVEKLREIAAVIRENLQAYRHN

SEQ ID NO: 359 - protein, 73 aa, ARTIFICIAL SEQUENCE
  synthetic construct
MGSWDEFGRRLAAIKTQLAALGGEEAELAAFEKEIAAFESELQAYKGKGNPEVEALRKEAAVIRENLQAYRHN

SEQ ID NO: 360 - protein, 73 aa, ARTIFICIAL SEQUENCE
  synthetic construct
MGSWDEFGRRLAAIKTQLAALGGTEAELAAFEKEIAAFESELQAYKGKGNPEVEALRKEAAVIRENLQAYRHN

SEQ ID NO: 361 - protein, 73 aa, ARTIFICIAL SEQUENCE
  synthetic construct
MGSWDEFEQRLIAIEERLFALGGSEAELAAFEKEIAAFESELQAYKGKGNPEVEWLREEAAVIRKYLQAYRHN

SEQ ID NO: 362 - protein, 73 aa, ARTIFICIAL SEQUENCE
  synthetic construct
MGSWVEFDQRLGAIWDRLVALGGSEAELAAFEKEIAAFESELQAYKGKGNPEVEHLRQGAAVIRDDLQAYRHN

SEQ ID NO: 363 - protein, 73 aa, ARTIFICIAL SEQUENCE
  synthetic construct
MGSWVEFDMRLSAIWERLIALGGSEAELAAFEKEIAAFESELQAYKGKGNPEVEWLREDAAEIREFLQAYRHN

SEQ ID NO: 364 - protein, 73 aa, ARTIFICIAL SEQUENCE
  synthetic construct
MGSWVEFDQRLDAIYERLYALGGSEAELAAFEKEIAAFESELQAYKGKGNPEVEWLRDEAAEIREHLQAYRHN

SEQ ID NO: 365 - protein, 73 aa, ARTIFICIAL SEQUENCE
  synthetic construct
MGSWHEFDQRLWAIEERLWALGGSEAELAAFEKEIAAFESELQAYKGKGNPEVETLRLYAALIRHDLQAYRHN

SEQ ID NO: 366 - protein, 73 aa, ARTIFICIAL SEQUENCE
  synthetic construct
MGSWVEFWDRLDAIEGRLWALGGSEAELAAFEKEIAAFESELQAYKGKGNPEVEDLRWLAAEIRADLQAYRHN

SEQ ID NO: 367 - protein, 73 aa, ARTIFICIAL SEQUENCE
  synthetic construct
MGSWVEFYSRLDAIEDRLWALGGSEAELAAFEKEIAAFESELQAYKGKGNPEVEWLRIAAASIREDLQAYRHN

SEQ ID NO: 368 - protein, 73 aa, ARTIFICIAL SEQUENCE
  synthetic construct
MGSWYEFYERLDAIEERLWALGGSEAELAAFEKEIAAFESELQAYKGKGNPEVEVLRDWAAWIREDLQAYRHN

SEQ ID NO: 369 - protein, 73 aa, ARTIFICIAL SEQUENCE
  synthetic construct
MGSWFEFDDRLWAIENRLWALGGSEAELAAFEKEIAAFESELQAYKGKGNPEVEVLRDNAAWIREILQAYRHN

SEQ ID NO: 370 - protein, 73 aa, ARTIFICIAL SEQUENCE
  synthetic construct
MGSWYEFWDRLDALEDRLWALGGSEAELAAFEKEIAAFESELQAYKGKGNPEVEYLRDSAAFIREELQAYRHN

SEQ ID NO: 371 - protein, 73 aa, ARTIFICIAL SEQUENCE
  synthetic construct
MGSWMEFVDRLDAIESRLWALGGSEAELAAFEKEIAAFESELQAYKGKGNPEVEWLRIEAAFIREELQAYRHN

SEQ ID NO: 372 - protein, 73 aa, ARTIFICIAL SEQUENCE
  synthetic construct
MGSWDEFVDRLWAIEERLWALGGSEAELAAFEKEIAAFESELQAYKGKGNPEVEELRIQAAIIREALQAYRHN

SEQ ID NO: 373 - protein, 73 aa, ARTIFICIAL SEQUENCE
  synthetic construct
MGSWFEFNYRLGAIEDRLWALGGSEAELAAFEKEIAAFESELQAYKGKGNPEVEMLRQIAAEIREFLQAYRHN

SEQ ID NO: 374 - protein, 73 aa, ARTIFICIAL SEQUENCE
  synthetic construct
MGSWEEFFTRLDAINERLEALGGSEAELAAFEKEIAAFESELQAYKGKGNPEVEMLRYEAAEIRHMLQAYRHN

SEQ ID NO: 375 - protein, 73 aa, ARTIFICIAL SEQUENCE
  synthetic construct
MGSWYEFSNRLDAIGERLWALGGSEAELAAFEKEIAAFESELQAYKGKGNPEVEILRHQAAEIRWFLQAYRHN

SEQ ID NO: 376 - protein, 73 aa, ARTIFICIAL SEQUENCE
  synthetic construct
MGSWYEFWGRLDAIEERLWALGGSEAELAAFEKEIAAFESELQAYKGRGNPEVEMLREDAAEIRGQLQAYRHN

SEQ ID NO: 377 - protein, 73 aa, ARTIFICIAL SEQUENCE
  synthetic construct
MGSWVEFWDRLWAIDYRLFALGGSEAELAAFEKEIAAFESELQAYKGKGNPEVEALRDEAAWIREELQAYRHN

SEQ ID NO: 378 - protein, 73 aa, ARTIFICIAL SEQUENCE
  synthetic construct
MGSWVEFVDRLWAIDERLDALGGSEAELAAFEKEIAAFESELQAYKGKGNPEVEFLRTWAAWIREDLQAYRHN

SEQ ID NO: 379 - protein, 73 aa, ARTIFICIAL SEQUENCE
  synthetic construct
MGSWFEFWDRLEAIWERLDALGGSEAELAAFEKEIAAFESELQAYKGKGNPEVEELRREAAIIREDLQAYRHN

SEQ ID NO: 380 - protein, 73 aa, ARTIFICIAL SEQUENCE
  synthetic construct
MGSWFEFEDRLEAIYQRLDALGGSEAELAAFEKEIAAFESELQAYKGKGNPEVEWLRDEAAWIRSDLQAYRHN

SEQ ID NO: 381 - protein, 73 aa, ARTIFICIAL SEQUENCE
  synthetic construct
MGSWFEFHDRLWAIDERLWALGGSEAELAAFEKEIAAFESELQAYKGKGNPEVEILREEAADIRLDLQAYRHN

SEQ ID NO: 382 - protein, 73 aa, ARTIFICIAL SEQUENCE
  synthetic construct
MGSWYEFEDRLWAIDNRLWALGGSEAELAAFEKEIAAFESELQAYKGKGNPEVEELRVHAADIRDDLQAYRHN

SEQ ID NO: 383 - protein, 73 aa, ARTIFICIAL SEQUENCE
  synthetic construct
MGSWFEFQDRLWAIDNRLWALGGSEAELAAFEKEIAAFESELQAYKGKGNPEVEELRDHAAMIRWELQAYRHN

SEQ ID NO: 384 - protein, 73 aa, ARTIFICIAL SEQUENCE
  synthetic construct
MGSWDEFEERLFAIDERLWALGGSEAELAAFEKEIAAFESELQAYKGKGNPEVEALRYLAADIREELQAYRHN

SEQ ID NO: 385 - protein, 73 aa, ARTIFICIAL SEQUENCE
  synthetic construct
MGSWEEFWERLDAIDTRLWALGGSEAELAAFEKEIAAFESELQAYKGKGNPEVEVLRNDAADIREPLQAYRHN

SEQ ID NO: 386 - protein, 73 aa, ARTIFICIAL SEQUENCE
  synthetic construct
MGSWMEFWERLEAIDMRLWALGGSEAELAAFEKEIAAFESELQAYKGKGNPEVEYLRDDAAVIRDDLQAYRHN

SEQ ID NO: 387 - protein, 73 aa, ARTIFICIAL SEQUENCE
  synthetic construct
MGSWLEFMWRLDAIDERLWALGGSEAELAAFEKEIAAFESELQAYKGKGNPEVELLREMAAAIRDDLQAYRHN

SEQ ID NO: 388 - protein, 73 aa, ARTIFICIAL SEQUENCE
  synthetic construct
MGSWTEFYNRLDAIDQRLWALGGSEAELAAFEKEIAAFESELQAYKGKGNPEVEMLREYAADIRTDLQAYRHN

SEQ ID NO: 389 - protein, 73 aa, ARTIFICIAL SEQUENCE
  synthetic construct
MGSWWEFIWRLEAIEQRLWALGGSEAELAAFEKEIAAFESELQAYKGKGNPEVEVLRSRAADIRTDLQAYRHN

SEQ ID NO: 390 - protein, 73 aa, ARTIFICIAL SEQUENCE
  synthetic construct
MGSWSEFYDRLWAIEERLFALGGSEAELAAFEKEIAAFESELQAYKGKGNPEVEYLRYYAAEIREELQAYRHN

SEQ ID NO: 391 - protein, 73 aa, ARTIFICIAL SEQUENCE
  synthetic construct
MGSWSEFEDRLWAIDQRLFALGGSEAELAAFEKEIAAFESELQAYKGKGNPEVEWLRAYAADIRWELQAYRHN

SEQ ID NO: 392 - protein, 73 aa, ARTIFICIAL SEQUENCE
  synthetic construct
MGSWTEFWERLNAIDERLFALGGSEAELAAFEKEIAAFESELQAYKGKGNPEVEWLRLYAAEIRSELQAYRHN

SEQ ID NO: 393 - protein, 73 aa, ARTIFICIAL SEQUENCE
  synthetic construct
MGSWWEFEERLWAIDYRLHALGGSEAELAAFEKEIAAFESELQAYKGKGNPEVEMLRSWAAEIRALLQAYRHN

SEQ ID NO: 394 - protein, 73 aa, ARTIFICIAL SEQUENCE
  synthetic construct
MGSWWEFENRLWAIEERLEALGGSEAELAAFEKEIAAFESELQAYKGKGNPEVEMLRNYAAEIRWELQAYRHN

SEQ ID NO: 395 - protein, 73 aa, ARTIFICIAL SEQUENCE
  synthetic construct
MGSWVEFEERLWAIDERLGALGGSEAELAAFEKEIAAFESELQAYKGKGNPEVEWLRDWAADIRWWLQAYRHN

SEQ ID NO: 396 - protein, 73 aa, ARTIFICIAL SEQUENCE
  synthetic construct
MGSWVEFEERLEAIEERLFALGGSEAELAAFEKEIAAFESELQAYKGKGNPEVEWLRDDAANIRHWLQAYRHN

SEQ ID NO: 397 - protein, 73 aa, ARTIFICIAL SEQUENCE
  synthetic construct
MGSWMEFEERLWAIDSRLWALGGSEAELAAFEKEIAAFESELQAYKGKGNPEVEWLRSEAAWIRMELQAYRHN

SEQ ID NO: 398 - protein, 73 aa, ARTIFICIAL SEQUENCE
  synthetic construct
MGSWSEFEHRLEAIESRLFALGGSEAELAAFEKEIAAFESELQAYKGKGNPEVEDLRSEAAWIREQLQAYRHN

SEQ ID NO: 399 - protein, 73 aa, ARTIFICIAL SEQUENCE
  synthetic construct
MGSWFEFWERLDAIEWRLWALGGSEAELAAFEKEIAAFESELQAYKGKGNPEVEELRSTAADIRRYLQAYRHN

SEQ ID NO: 400 - protein, 73 aa, ARTIFICIAL SEQUENCE
  synthetic construct
MGSWFEFWGRLEAIESRLKALGGSEAELAAFEKEIAAFESELQAYKGKGNPEVEELREHAAWIRAYLQAYRHN

SEQ ID NO: 401 - protein, 73 aa, ARTIFICIAL SEQUENCE
  synthetic construct
MGSWQEFTMRLDAIYNRLETLGGSEAELAAFEKEIAAFESELQAYKGKGNPEVEWLRQSAANIRSELQAYRHN

SEQ ID NO: 402 - protein, 73 aa, ARTIFICIAL SEQUENCE
  synthetic construct
MGSWSEFNMRLDAIYERLTALGGSEAELAAFEKEIAAFESELQAYKGKGNPEVEWLRHSAARIRLELQAYRHN

SEQ ID NO: 403 - protein, 73 aa, ARTIFICIAL SEQUENCE
  synthetic construct
MGSWSEFNMRLDAIYERLTALGGSEAELAAFEKEIAAFESELQAYKGKGNPEVEWLRHSAALIRLELQAYRHN

SEQ ID NO: 404 - protein, 73 aa, ARTIFICIAL SEQUENCE
  synthetic construct
MGSWIEFNMRLDAIYERLVALGGSEAELAAFEKEIAAFESELQAYKGKGNPEVEWLRKVAANIRLELQAYRHN

SEQ ID NO: 405 - protein, 73 aa, ARTIFICIAL SEQUENCE
  synthetic construct
MGSWYEFHHRLDAIYERLLALGGSEAELAAFEKEIAAFESELQAYKGKGNPEVEWLRSSAANIRKELQAYRHN

SEQ ID NO: 406 - protein, 73 aa, ARTIFICIAL SEQUENCE
  synthetic construct
MGSWYEFAKRLDAIYERLVALGGSEAELAAFEKEIAAFESELQAYKGKGNPEVEWLRSSAANIREELQAYRHN

SEQ ID NO: 407 - protein, 73 aa, ARTIFICIAL SEQUENCE
  synthetic construct
MGSWTEFYVRLDAIYERLDALGGSEAELAAFEKEIAAFESELQAYKGKGNPEVEWLRMVAANIRTELQAYRHN

SEQ ID NO: 408 - protein, 73 aa, ARTIFICIAL SEQUENCE
  synthetic construct
MGSWVEFYTRLDAIYGRLDALGGSEAELAAFEKEIAAFESELQAYKGKGNPEVEWLRQVAANIRMELQAYRHN

SEQ ID NO: 409 - protein, 73 aa, ARTIFICIAL SEQUENCE
  synthetic construct
MGSWVEFHMRLDAIYERLDALGGSEAELAAFEKEIAAFESELQAYKGKGNPEVEWLRTAAANIRVELQAYRHN

SEQ ID NO: 410 - protein, 73 aa, ARTIFICIAL SEQUENCE
  synthetic construct
MGSWYEFAIRLDAIYERLHALGGSEAELAAFEKEIAAFESELQAYKGKGNPEVEYLRVWAANIRTELQAYRHN

SEQ ID NO: 411 - protein, 73 aa, ARTIFICIAL SEQUENCE
  synthetic construct
MGSWNEFVIRLDAIYERLLALGGSEAELAAFEKEIAAFESELQAYKGKGNPEVEYLRMAAANIRMELQAYRHN

SEQ ID NO: 412 - protein, 73 aa, ARTIFICIAL SEQUENCE
  synthetic construct
MGSWSEFYVRVDAIYARLSALGGSEAELAAFEKEIAAFESELQAYKGKGNPEVEKLRVWAANIRHELQAYRHN

SEQ ID NO: 413 - protein, 73 aa, ARTIFICIAL SEQUENCE
  synthetic construct
MGSWSEFHVRLDAIYARLDALGGSEAELAAFEKEIAAFESELQAYKGKGNPEVERLREWAANIRRELQAYRHN

SEQ ID NO: 414 - protein, 73 aa, ARTIFICIAL SEQUENCE
  synthetic construct
MGSWVEFHLRLDAIYGRLMALGGSEAELAAFEKEIAAFESELQAYKGKGNPEVENLRVWAANIRNELQAYRHN

SEQ ID NO: 415 - protein, 73 aa, ARTIFICIAL SEQUENCE
  synthetic construct
MGSWVEFEMRLDAIVGRLYALGGSEAELAAFEKEIAAFESELQAYKGKGNPEVEKLRRWAANIRSELQAYRHN

SEQ ID NO: 416 - protein, 73 aa, ARTIFICIAL SEQUENCE
  synthetic construct
MGSWVEFNIRLDAIYERLYALGGSEAELAAFEKEIAAFESELQAYKGKGNPEVEKLRHWAASIRRELQAYRHN

SEQ ID NO: 417 - protein, 73 aa, ARTIFICIAL SEQUENCE
  synthetic construct
MGSWHEFGVRLDAIYDRLMALGGSEAELAAFEKEIAAFESELQAYKGKGNPEVEFLRQAAANIRSELQAYRHN

SEQ ID NO: 418 - protein, 73 aa, ARTIFICIAL SEQUENCE
  synthetic construct
MGSWTEFNLRLDAIYDRLMALGGSEAELAAFEKEIAAFESELQAYKGKGNPEVEWLRASAAAIRVELQAYRHN

SEQ ID NO: 419 - protein, 73 aa, ARTIFICIAL SEQUENCE
  synthetic construct
MGSWTEFNLRLDAIYGRLSALGGSEAELAAFEKEIAAFESELQAYKGKGNPEVEFLRAAAANIRVELQAYRHN

SEQ ID NO: 420 - protein, 73 aa, ARTIFICIAL SEQUENCE
  synthetic construct
MGSWVEFNWRLDAIYDRLVALGGSEAELAAFEKEIAAFESELQAYKGKGNPEVEWLRVSAAKIRGELQAYRHN

SEQ ID NO: 421 - protein, 73 aa, ARTIFICIAL SEQUENCE
  synthetic construct
MGSWNEFAWRLDAIYSRLAALGGSEAELAAFEKEIAAFESELQAYKGKGNPEVEWLRVAAANIRYELQAYRHN

SEQ ID NO: 422 - protein, 73 aa, ARTIFICIAL SEQUENCE
  synthetic construct
MGSWTEFAWRLDAIYDRLLALGGSEAELAAFEKEIAAFESELQAYKGKGNPEVEWLRHVAANIRRELQAYRHN

SEQ ID NO: 423 - protein, 73 aa, ARTIFICIAL SEQUENCE
  synthetic construct
MGSWVEFSIRLDAIYTRLVALGGSEAELAAFEKEIAAFESELQAYKGKGNPEVEMLRKGAANIRKELQAYRHN

SEQ ID NO: 424 - protein, 73 aa, ARTIFICIAL SEQUENCE
  synthetic construct
MGSWVEFYIRLDAIYVRLMALGGSEAELAAFEKEIAAFESELQAYKGKGNPEVEKLRSYAANIRQELQAYRHN

SEQ ID NO: 425 - protein, 73 aa, ARTIFICIAL SEQUENCE
  synthetic construct
MGSWYEFSMRLDAIYDRLMALGGSEAELAAFEKEIAAFESELQAYKGKGNPEVEQLRGYAANIRNELQAYRHN

SEQ ID NO: 426 - protein, 73 aa, ARTIFICIAL SEQUENCE
  synthetic construct
MGSWVEFIYRLDAIYDRLEALGGSEAELAAFEKEIAAFESELQAYKGKGNPEVEVLRRYAANIRNELQAYRHN

SEQ ID NO: 427 - protein, 73 aa, ARTIFICIAL SEQUENCE
  synthetic construct
MGSWIEFEVRLDAIYNRLAALGGSEAELAAFEKEIAAFESELQAYKGKGNPEVERLRRYAANIRHELQAYRHN

SEQ ID NO: 428 - protein, 73 aa, ARTIFICIAL SEQUENCE
  synthetic construct
MGSWFEFYDRLDAIYMRLIALGGSEAELAAFEKEIAAFESELQAYKGKGNPEVEVLRRYAANIRAELQAYRHN

SEQ ID NO: 429 - protein, 73 aa, ARTIFICIAL SEQUENCE
  synthetic construct
MGSWFEFYMRLDAIYDRLTALGGSEAELAAFEKEIAAFESELQAYKGKGNPEVERLRTFAANIRKELQAYRHN

SEQ ID NO: 430 - protein, 73 aa, ARTIFICIAL SEQUENCE
  synthetic construct
MGSWYEFDYRLDAIYDRLAALGGSEAELAAFEKEIAAFESELQAYKGKGNPEVERLRKWAANIREELQAYRHN

SEQ ID NO: 431 - protein, 73 aa, ARTIFICIAL SEQUENCE
  synthetic construct
MGSWSEFYLRLDAIYDRLDALGGSEAELAAFEKEIAAFESELQAYKGKGNPEVEWLRKTAANIREELQAYRHN

SEQ ID NO: 432 - protein, 73 aa, ARTIFICIAL SEQUENCE
  synthetic construct
MGSWFEFYERLDAINWRLFALGGSEAELAAFEKEIAAFESELQAYKGKGNPEVEALRGEAAAIREDLQAYRHN

SEQ ID NO: 433 - protein, 73 aa, ARTIFICIAL SEQUENCE
  synthetic construct
MGSWNEFEDRLDAIWWRLFALGGSEAELAAFEKEIAAFESELQAYKGKGNPEVEALRVEAAFIRTMLQAYRHN

SEQ ID NO: 434 - protein, 73 aa, ARTIFICIAL SEQUENCE
  synthetic construct
MGSWFYFKDDLADINYMLEALGGSEAELAMFEDDIAGFELTLLKYKGKGNPEVEALRKEAAAIRDELQAYRHN

SEQ ID NO: 435 - protein, 73 aa, ARTIFICIAL SEQUENCE
  synthetic construct
MGSWHFFKDDLAWIKNELEALGGSEAELAMFEDDIAMFETMLQSYKGKGNPEVEALRKEAAAIRDELQAYRHN

SEQ ID NO: 436 - protein, 73 aa, ARTIFICIAL SEQUENCE
  synthetic construct
MGSWHWFKTDLADIKEELEALGGSEAELAMFEDDIAEFEEFLQMYKGKGNPEVEALRKEAAAIRDELQAYRHN

SEQ ID NO: 437 - protein, 73 aa, ARTIFICIAL SEQUENCE
  synthetic construct
MGSWWLFKDDLAEIKYWLEALGGSEAELAFFEDDIAEFERGLQIYKGKGNPEVEALRKEAAAIRDELQAYRHN

SEQ ID NO: 438 - protein, 73 aa, ARTIFICIAL SEQUENCE
  synthetic construct
MGSWYEFKDDLAEIKEWLEALGGSEAELAFFELDIADFEWLLQLYKGKGNPEVEALRKEAAAIRDELQAYRHN

SEQ ID NO: 439 - protein, 73 aa, ARTIFICIAL SEQUENCE
  synthetic construct
MGSWQWFKDDLAYIKETLEALGGSEAELALFEDMIADFEFELQWYKGKGNPEVEALRKEAAAIRDELQAYRHN

SEQ ID NO: 440 - protein, 73 aa, ARTIFICIAL SEQUENCE
  synthetic construct
MGSWILFKDDLAWIKETLEALGGSEAELAFFEDNIADFEEQLQGYKGKGNPEVEALRKEAAAIRDELQAYRHN

SEQ ID NO: 441 - protein, 73 aa, ARTIFICIAL SEQUENCE
  synthetic construct
MGSWIVFKDDLADIKRWLEALGGSEAELAMFEDEIADFEWQLQDYKGKGNPEVEALRKEAAAIRDELQAYRHN

SEQ ID NO: 442 - protein, 73 aa, ARTIFICIAL SEQUENCE
  synthetic construct
MGSWGHFKQDLAWIKDTLEALGGSEAELAFFEDDIAMFEMELQDYKGKGNPEVEALRKEAAAIRDELQAYRHN

SEQ ID NO: 443 - protein, 73 aa, ARTIFICIAL SEQUENCE
  synthetic construct
MGSWGYFKDDLAWIKGELEALGGSEAELAEFEWFIAVFEEDLQVYKGKGNPEVEALRKEAAAIRDELQAYRHN

SEQ ID NO: 444 - protein, 73 aa, ARTIFICIAL SEQUENCE
  synthetic construct
MGSWYWFKDDLAEIKGLLEALGGSEAELAEFEDEIAVFEQELQEYKGKGNPEVEALRKEAAAIRDELQAYRHN

SEQ ID NO: 445 - protein, 73 aa, ARTIFICIAL SEQUENCE
  synthetic construct
MGSWMFFKEDLADIKWALEALGGSEAELAFFEEEIALFEQHLQQYKGKGNPEVEALRKEAAAIRDELQAYRHN

SEQ ID NO: 446 - protein, 73 aa, ARTIFICIAL SEQUENCE
  synthetic construct
MGSWTFFKEDLAGIKWELEALGGSEAELAWFEDEIALFEEELQEYKGKGNPEVEALRKEAAAIRDELQAYRHN

SEQ ID NO: 447 - protein, 73 aa, ARTIFICIAL SEQUENCE
  synthetic construct
MGSWVFFKDDLADIKDELEALGGSEAELAFFEIAIALFEWELQEYKGKGNPEVEALRKEAAAIRDELQAYRHN

SEQ ID NO: 448 - protein, 73 aa, ARTIFICIAL SEQUENCE
  synthetic construct
MGSWTFFKNDLAEIKDWLEALGGSEAELADFEWDIAEFEYSLQEYKGKGNPEVEALRKEAAAIRDELQAYRHN

SEQ ID NO: 449 - protein, 73 aa, ARTIFICIAL SEQUENCE
  synthetic construct
MGSWTYFKDDLADIKQWLEALGGSEAELAFFEIEIAEFEEELQEYKGKGNPEVEALRKEAAAIRDELQAYRHN

SEQ ID NO: 450 - protein, 73 aa, ARTIFICIAL SEQUENCE
  synthetic construct
MGSWTVFKYDLADIKWWLEALGGSEAELADFEEEIAEFEEELQEYKGKGNPEVEALRKEAAAIRDELQAYRHN

SEQ ID NO: 451 - protein, 73 aa, ARTIFICIAL SEQUENCE
  synthetic construct
MGSWYWFKQDLAHIKSMLEALGGSEAELAWFEEDIADFESELQEYKGKGNPEVEALRKEAAAIRDELQAYRHN

SEQ ID NO: 452 - protein, 73 aa, ARTIFICIAL SEQUENCE
  synthetic construct
MGSWTFFKWDLADIKANLEALGGSEAELAWFEEDLAGFEAELQEYKGKGNPEVEALRKEAAAIRDELQAYRHN

SEQ ID NO: 453 - protein, 73 aa, ARTIFICIAL SEQUENCE
  synthetic construct
MGSWSFFKEELANIQVYLEALGGSEAELAWFEEDIADFEEDLQHYKGKGNPEVEALRKEAAAIRDELQAYRHN

SEQ ID NO: 454 - protein, 73 aa, ARTIFICIAL SEQUENCE
  synthetic construct
MGSWEFFKYELADIKDELEALGGSEAELAWFEEDIATFEEWLQGYKGKGNPEVEALRKEAAAIRDELQAYRHN

SEQ ID NO: 455 - protein, 73 aa, ARTIFICIAL SEQUENCE
  synthetic construct
MGSWQTFKDELAHIKWELEALGGSEAELAWFEWDIANFEEELQEYKGKGNPEVEALRKEAAAIRDELQAYRHN

SEQ ID NO: 456 - protein, 73 aa, ARTIFICIAL SEQUENCE
  synthetic construct
MGSWYWFKEELAFIKWELEALGGSEAELALFEEDIAYFEEMLQEYKGKGNPEVEALRKEAAAIRDELQAYRHN

SEQ ID NO: 457 - protein, 73 aa, ARTIFICIAL SEQUENCE
  synthetic construct
MGSWNSFKDELAEIKAELEALGGSEAELAFFEEDIAWFEEHLQQYKGKGNPEVEALRKEAAAIRDELQAYRHN

SEQ ID NO: 458 - protein, 73 aa, ARTIFICIAL SEQUENCE
  synthetic construct
MGSWDLFKWELAEIKLGLEALGGSEAELAEFEYDIAWFEEDLQDYKGKGNPEVEALRKEAAAIRDELQAYRHN

SEQ ID NO: 459 - protein, 73 aa, ARTIFICIAL SEQUENCE
  synthetic construct
MGSWIFFKQDLAEIKLNLEALGGSEAELAWFEDDIAWFESHLQDYKGKGNPEVEALRKEAAAIRDELQAYRHN

SEQ ID NO: 460 - protein, 73 aa, ARTIFICIAL SEQUENCE
  synthetic construct
MGSWHLFKWTLAEIKYELEALGGSEAELAWFEDDIATFEEELQWYKGKGNPEVEALRKEAAAIRDELQAYRHN

SEQ ID NO: 461 - protein, 73 aa, ARTIFICIAL SEQUENCE
  synthetic construct
MGSWVTFKDELADIKDFLEALGGSEAELAFFEVDIAEFEAELQFYKGKGNPEVEALRKEAAAIRDELQAYRHN

SEQ ID NO: 462 - protein, 73 aa, ARTIFICIAL SEQUENCE
  synthetic construct
MGSWVYFKDELADIKDFLEALGGSEAELAEFEEDIATFEYDLQWYKGKGNPEVEALRKEAAAIRDELQAYRHN

SEQ ID NO: 463 - protein, 73 aa, ARTIFICIAL SEQUENCE
  synthetic construct
MGSWETFKYELAEIKDYLEALGGSEAELAWFEDDIAEFEFELQYYKGKGNPEVEALRKEAAAIRDELQAYRHN

SEQ ID NO: 464 - protein, 73 aa, ARTIFICIAL SEQUENCE
  synthetic construct
MGSWNTFKYELAEIKHFLEALGGSEAELAMFEDDIAMFEWELQEYKGKGNPEVEALRKEAAAIRDELQAYRHN

SEQ ID NO: 465 - protein, 73 aa, ARTIFICIAL SEQUENCE
  synthetic construct
MGSWYVFKDELAEIKQFLEALGGSEAELAWFEDDIAEFETQLQHYKGKGNPEVEALRKEAAAIRDELQAYRHN

SEQ ID NO: 466 - protein, 73 aa, ARTIFICIAL SEQUENCE
  synthetic construct
MGSWIFFKEQLAIIKWELEALGGSEAELAWFEDDIAAFEDDLQFYKGQGNPEVEALRKEAAAIRDELQAYRHN

SEQ ID NO: 467 - protein, 73 aa, ARTIFICIAL SEQUENCE
  synthetic construct
MGSWEFFKEVLAEIKYDLEALGGSEAELAWFETDIAGFEIDLQVYKGKGNPEVEALRKEAAAIRDELQAYRHN

SEQ ID NO: 468 - protein, 73 aa, ARTIFICIAL SEQUENCE
  synthetic construct
MGSWVFFKEDLATIKNDLEALGGSEAELAWFEMMIADFEADLQYYKGKGNPEVEALRKEAAAIRDELQAYRHN

SEQ ID NO: 469 - protein, 73 aa, ARTIFICIAL SEQUENCE
  synthetic construct
MGSWEEFKEDLAEIKVWLEALGGSEAELAWFEMGIADFEDGLQFYKGKGNPEVEALRKEAAAIRDELQAYRHN

SEQ ID NO: 470 - protein, 73 aa, ARTIFICIAL SEQUENCE
  synthetic construct
MGSWHWFKEDLANIKDWLEALGGSEAELAWFEDNIADFEGDLQVYKGKGNPEVEALRKEAAAIRDELQAYRHN

SEQ ID NO: 471 - protein, 73 aa, ARTIFICIAL SEQUENCE
  synthetic construct
MGSWFWFKEDLAFIKEDLEALGGSEAELAWFEDGIAFFEWDLQDYKGKGNPEVEALRKEAAAIRDELQAYRHN

SEQ ID NO: 472 - protein, 73 aa, ARTIFICIAL SEQUENCE
  synthetic construct
MGSWQWFKEDLAEIKHDLEALGGSEAELAWFEDFIAQFEFDLQWYKGKGNPEVEALRKEAAAIRDELQAYRHN

SEQ ID NO: 473 - protein, 73 aa, ARTIFICIAL SEQUENCE
  synthetic construct
MGSWHWFKEDLAIIKQDLEALGGSEAELATFEQWIAEFEWDLQEYKGKGNPEVEALRKEAAAIRDELQAYRHN

SEQ ID NO: 474 - protein, 73 aa, ARTIFICIAL SEQUENCE
  synthetic construct
MGSWNWFKEDLAIIKMDLEALGGSEAELAWFEHNIAGFEFELQGYKGKGNPEVEALRKEAAAIRDELQAYRHN

SEQ ID NO: 475 - protein, 73 aa, ARTIFICIAL SEQUENCE
  synthetic construct
MGSWSWFKEDLAEIKMELEALGGSEAELAYFEWYIAEFEFQLQHYKGKGNPEVEALRKEAAAIRDELQAYRHN

SEQ ID NO: 476 - protein, 73 aa, ARTIFICIAL SEQUENCE
  synthetic construct
MGSWSWFKQDLADIKIQLEALGGSEAELAWFEWDIAEFEFELQDYKGKGNPEVEALRKEAAAIRDELQAYRHN

SEQ ID NO: 477 - protein, 73 aa, ARTIFICIAL SEQUENCE
  synthetic construct
MGSWSWFKEDLADIKFELEALGGSEAELAWFELDIADFEQALQQYKGKGNPEVEALRKEAAAIRDELQAYRHN

SEQ ID NO: 478 - protein, 73 aa, ARTIFICIAL SEQUENCE
  synthetic construct
MGSWSWFKEDLASIKAVLEALGGSEAELAFFESDIAEFEQELQYYKGKGNPEVEALRKEAAAIRDELQAYRHN

SEQ ID NO: 479 - protein, 73 aa, ARTIFICIAL SEQUENCE
  synthetic construct
MGSWWEFKEDLAEIKWFLEALGGSEAELAWFEHDIAKFEFELQYYKGKGNPEVEALRKEAAAIRDELQAYRHN

SEQ ID NO: 480 - protein, 73 aa, ARTIFICIAL SEQUENCE
  synthetic construct
MGSWEWFKSDLASIKWELEALGGSEAELAWFEHDIAEFEEDLQWYKGKGNPEVEALRKEAAAIRDELQAYRHN

SEQ ID NO: 481 - protein, 73 aa, ARTIFICIAL SEQUENCE
  synthetic construct
MGSWNEFKDDLAMIKMTLEALGGSEAELAWFEHDIAEFEDDLQWYKGKGNPEVEALRKEAAAIRDELQAYRHN

SEQ ID NO: 482 - protein, 73 aa, ARTIFICIAL SEQUENCE
  synthetic construct
MGSWTFFKDDLAEIKWMLEALGGSEAELAWFESDIAYFEDELQWYKGKGNPEVEALRKEAAAIRDELQAYRHN

SEQ ID NO: 483 - protein, 73 aa, ARTIFICIAL SEQUENCE
  synthetic construct
MGSWSDFKDDLAEIKMILEALGGSEAELAYFENDIAWFEDDLQEYKGKGNPEVEALRKEAAAIRDELQAYRHN

SEQ ID NO: 484 - protein, 73 aa, ARTIFICIAL SEQUENCE
  synthetic construct
MGSWSMFKDDLAEIKASLEALGGSEAELAWFEDDIAWFEDDLQHYKGKGNPEVEALRKEAAAIRDELQAYRHN

SEQ ID NO: 485 - protein, 73 aa, ARTIFICIAL SEQUENCE
  synthetic construct
MGSWQYFKDDLAEIKMVLEALGGSEAELAWFEADIAMFEDDLQIYKGKGNPEVEALRKEAAAIRDELQAYRHN

SEQ ID NO: 486 - protein, 73 aa, ARTIFICIAL SEQUENCE
  synthetic construct
MGSWSFFKDDLAEIKYFLEALGGSEAELAMFEQTIAEFEYDLQDYKGKGNPEVEALRKEAAAIRDELQAYRHN

SEQ ID NO: 487 - protein, 73 aa, ARTIFICIAL SEQUENCE
  synthetic construct
MGSWMEFKEELAEIKYILEALGGSEAELAWFEQSIADFEYDLQDYKGKGNPEVEALRKEAAAIRDELQAYRHN

SEQ ID NO: 488 - protein, 73 aa, ARTIFICIAL SEQUENCE
  synthetic construct
MGSWAWFKEDLAEIKVFLEALGGSEAELAEFEVSIADFEYELQDYKGKGNPEVEALRKEAAAIRDELQAYRHN

SEQ ID NO: 489 - protein, 73 aa, ARTIFICIAL SEQUENCE
  synthetic construct
MGSWYEFKFDLAEIKEQLEALGGSEAELALFEDDIAFFEYDLQNYKGKGNPEVEALRKEAAAIRDELQAYRHN

SEQ ID NO: 490 - protein, 73 aa, ARTIFICIAL SEQUENCE
  synthetic construct
MGSWYDFKYDLAEIKMDLEALGGSEAELAQFEFDIAFFEEELQDYKGKGNPEVEALRKEAAAIRDELQAYRHN

SEQ ID NO: 491 - protein, 73 aa, ARTIFICIAL SEQUENCE
  synthetic construct
MGSWYIFKEDLAEIKEELEALGGSEAELAYFEEEIALFEMELQWYKGKGNPEVEALRKEAAAIRDELQAYRHN

SEQ ID NO: 492 - protein, 73 aa, ARTIFICIAL SEQUENCE
  synthetic construct
MGSWVLFKEELAYIKFELEALGGSEAELALFENVIAIFESNLQNYKGKGNPEVEALRKEAAAIRDELQAYRHN

SEQ ID NO: 493 - protein, 73 aa, ARTIFICIAL SEQUENCE
  synthetic construct
MGSWQDFKEDLAWIKYELEALGGSEAELAFFEYDIAIFENNLQHYKGKGNPEVEALRKEAAAIRDELQAYRHN

SEQ ID NO: 494 - protein, 73 aa, ARTIFICIAL SEQUENCE
  synthetic construct
MGSWDHFKNDLAWIKKHLEALGGSEAELAEFEAVIAYFELYLQGYKGKGNPEVEALRKEAAAIRDELQAYRHN

SEQ ID NO: 495 - protein, 73 aa, ARTIFICIAL SEQUENCE
  synthetic construct
MGSWYDFKEDLADIKWMLEALGGSEAELAEFENVIAYFENDLQEYKGKGNPEVEALRKEAAAIRDELQAYRHN

SEQ ID NO: 496 - protein, 73 aa, ARTIFICIAL SEQUENCE
  synthetic construct
MGSWYMFKEELADIKWYLEALGGSEAELAWFEDDIAGFEWDLQAYKGKGNPEVEALRKEAAAIRDELQAYRHN

SEQ ID NO: 497 - protein, 73 aa, ARTIFICIAL SEQUENCE
  synthetic construct
MGSWYYFKDELADIKWDLEALGGSEAELAWFEMLIAQFELDLQWYKGKGNPEVEALRKEAAAIRDELQAYRHN

SEQ ID NO: 498 - protein, 73 aa, ARTIFICIAL SEQUENCE
  synthetic construct
MGSWMYFKDTLADIKWYLEALGGSEAELAFFEDWIAEFEDDLQVYKGKGNPEVEALRKEAAAIRDELQAYRHN

SEQ ID NO: 499 - protein, 73 aa, ARTIFICIAL SEQUENCE
  synthetic construct
MGSWYQFKHDLADIKYGLEALGGSEAELAWFEDDIADFELDLQYYKGKGNPEVEALRKEAAAIRDELQAYRHN

SEQ ID NO: 500 - protein, 73 aa, ARTIFICIAL SEQUENCE
  synthetic construct
MGSWYVFKDDLADIKYMLEALGGSEAELAWFEWEIANFEFDLQYYKGKGNPEVEALRKEAAAIRDELQAYRHN

SEQ ID NO: 501 - protein, 73 aa, ARTIFICIAL SEQUENCE
  synthetic construct
MGSWNFFKYDLADIMAYLEALGGSEAELAFFEDEIANFEHDLQKYKGKGNPEVEALRKEAAAIRDELQAYRHN

SEQ ID NO: 502 - protein, 73 aa, ARTIFICIAL SEQUENCE
  synthetic construct
MGSWHWFKIVLADIKDGLEALGGSEAELAYFETTIADFEMDLQHYKGKGNPEVEALRKEAAAIRDELQAYRHN

SEQ ID NO: 503 - protein, 73 aa, ARTIFICIAL SEQUENCE
  synthetic construct
MGSWHWFKIVLADIKDGLEALGGSEAELAYFETTIADFEMDLHHYKGKGNPEVEALRKEAAAIRDELQAYRHN

SEQ ID NO: 504 - protein, 73 aa, ARTIFICIAL SEQUENCE
  synthetic construct
MGSWFMFKEELADIKDWLEALGGSEAELASFESYIAWFEQDLQWYKGKGNPEVEALRKEAAAIRDELQAYRHN

SEQ ID NO: 505 - protein, 73 aa, ARTIFICIAL SEQUENCE
  synthetic construct
MGSWFMFKQELAWIKEDLEALGGSEAELADFEWDIAEFEWDLQYYKGKGNPEVEALRKEAAAIRDELQAYRHN

SEQ ID NO: 506 - protein, 73 aa, ARTIFICIAL SEQUENCE
  synthetic construct
MGSWQIFKGELAYIKQYLEALGGSEAELAFFEFDIAEFEEDLQYYKGKGNPEVEALRKEAAAIRDELQAYRHN

SEQ ID NO: 507 - protein, 73 aa, ARTIFICIAL SEQUENCE
  synthetic construct
MGSWDFFKEELAEIKHYLEALGGSEAELAFFEFWIADFEQDLQEYKGKGNPEVEALRKEAAAIRDELQAYRHN

SEQ ID NO: 508 - protein, 73 aa, ARTIFICIAL SEQUENCE
  synthetic construct
MGSWFNFKEELAVIKFQLEALGGSEAELAFFEWVIADFEDDLQEYKGKGNPEVEALRKEAAAIRDELQAYRHN

SEQ ID NO: 509 - protein, 73 aa, ARTIFICIAL SEQUENCE
  synthetic construct
MGSWYQFKTELAWIKDDLEALGGSEAELAWFEWVIADFEDDLQFYKGKGNPEVEALRKEAAAIRDELQAYRHN

SEQ ID NO: 510 - protein, 73 aa, ARTIFICIAL SEQUENCE
  synthetic construct
MGSWFEFKDYLADIKWDLEALGGSEAELAIFEHDIAYFEHNLQQYKGKGNPEVEALRKEAAAIRDELQAYRHN

SEQ ID NO: 511 - protein, 73 aa, ARTIFICIAL SEQUENCE
  synthetic construct
MGSWVRFKDFLADIKMDLEALGGSEAELADFEYHIAEFEHNLQEYKGKGNPEVEALRKEAAAIRDELQAYRHN

SEQ ID NO: 512 - protein, 73 aa, ARTIFICIAL SEQUENCE
  synthetic construct
MGSWWLFKEQLALIKYNLEALGGSEAELADFESWIAEFEHQLQEYKGKGNPEVEALRKEAAAIRDELQAYRHN

SEQ ID NO: 513 - protein, 73 aa, ARTIFICIAL SEQUENCE
  synthetic construct
MGSWHVFKTELADIKFYLEALGGSEAELAMFELWIAEFEHELQDYKGKGNPEVEALRKEAAAIRDELQAYRHN

SEQ ID NO: 514 - protein, 73 aa, ARTIFICIAL SEQUENCE
  synthetic construct
MGSWIWFKDWLADIKDLLEALGGSEAELAEFEYDIALFEDQLQAYKGKGNPEVEALRKEAAAIRDELQAYRHN

SEQ ID NO: 515 - protein, 73 aa, ARTIFICIAL SEQUENCE
  synthetic construct
MGSWGWFKHELAFIKADLEALGGSEAELAWFEEEIAEFEYELQFYKGKGNPEVEALRKEAAAIRDELQAYRHN

SEQ ID NO: 516 - protein, 73 aa, ARTIFICIAL SEQUENCE
  synthetic construct
MGSWTWFKDNLAWIKEDLEALGGSEAELAWFELEIASFETALQDYKGKGNPEVEALRKEAAAIRDELQAYRHN

SEQ ID NO: 517 - protein, 73 aa, ARTIFICIAL SEQUENCE
  synthetic construct
MGSWTYFKNDLAGIKEDLEALGGSEAELAQFEFEIAEFEWLLQDYKGKGNPEVEALRKEAAAIRDELQAYRHN

SEQ ID NO: 518 - protein, 73 aa, ARTIFICIAL SEQUENCE
  synthetic construct
MGSWTWFKWDLADIKGDLEALGGSEAELAFFEEEIAEFEWRLQDYKGKGNPEVEALRKEAAAIRDELQAYRHN

SEQ ID NO: 519 - protein, 73 aa, ARTIFICIAL SEQUENCE
  synthetic construct
MGSWLYFKEYLADIKSDLEALGGSEAELAWFEYEIADFEEQLQYYKGKGNPEVEALRKEAAAIRDELQAYRHN

SEQ ID NO: 520 - protein, 73 aa, ARTIFICIAL SEQUENCE
  synthetic construct
MGSWHWFKEELAEIKEDLVALGGSEAELAWFEYDIAMFELSLQNYKGKGNPEVEALRKEAAAIRDELQAYRHN

SEQ ID NO: 521 - protein, 73 aa, ARTIFICIAL SEQUENCE
  synthetic construct
MGSWNDFKEELAWIKFDLEALGGSEAELAWFEEDIAMFEQQLQAYKGKGNPEVEALRKEAAAIRDELQAYRHN

SEQ ID NO: 522 - protein, 73 aa, ARTIFICIAL SEQUENCE
  synthetic construct
MGSWWDFKDWLAEIKHDLEALGGSEAELALFESEIADFEFGLQWYKGKGNPEVEALRKEAAAIRDELQAYRHN

SEQ ID NO: 523 - protein, 73 aa, ARTIFICIAL SEQUENCE
  synthetic construct
MGSWDEFKEDLAHIKTDLEALGGSEAELALFEDEIADFEMYLQHYKGKGNPEVEALRKEAAAIRDELQAYRHN

SEQ ID NO: 524 - protein, 73 aa, ARTIFICIAL SEQUENCE
  synthetic construct
MGSWDFFKYDLANINEWLEALGGSEAELADFEYGIADFELWLQDYKGKGNPEVEALRKEAAAIRDELQAYRHN

SEQ ID NO: 525 - protein, 73 aa, ARTIFICIAL SEQUENCE
  synthetic construct
MGSWYQFKDDLAHIKHLLEALGGSEAELAVFEYIIADFESFLQIYKGKGNPEVEALRKEAAAIRDELQAYRHN

SEQ ID NO: 526 - protein, 73 aa, ARTIFICIAL SEQUENCE
  synthetic construct
MGSWAEFKHDLADIKRELEALGGSEAELAWFELSIAFFEDELQHYKGKGNPEVEALRKEAAAIRDELQAYRHN

SEQ ID NO: 527 - protein, 73 aa, ARTIFICIAL SEQUENCE
  synthetic construct
MGSWVVFKQDLADINHQLEALGGSEAELAWFEWEIADFEWELQHYKGKGNPEVEALRKEAAAIRDELQAYRHN

SEQ ID NO: 528 - protein, 73 aa, ARTIFICIAL SEQUENCE
  synthetic construct
MGSWFQFKEFLAMITHNLEALGGSEAELAEFEHDIALFESELQQYKGKGNPEVEALRKEAAAIRDELQAYRHN

SEQ ID NO: 529 - protein, 73 aa, ARTIFICIAL SEQUENCE
  synthetic construct
MGSWHWFKEDLAMITDVLEALGGSEAELAAFESEIAVFEADLQYYKGKGNPEVEALRKEAAAIRDELQAYRHN

SEQ ID NO: 530 - protein, 73 aa, ARTIFICIAL SEQUENCE
  synthetic construct
MGSWSWFQWDLAGIKDHLEALGGSEAELAEFESEIAYFEDELQWYKGKGNPEVEALRKEAAAIRDELQAYRHN

SEQ ID NO: 531 - protein, 73 aa, ARTIFICIAL SEQUENCE
  synthetic construct
MGSWTEFKGELAEIKWILEALGGSEAELAFFEDEIAAFEWDLQKYKGKGNPEVEALRKEAAAIRDELQAYRHN

SEQ ID NO: 532 - protein, 73 aa, ARTIFICIAL SEQUENCE
  synthetic construct
MGSWFEFKWTLALIKQELEALGGSEAELADFEQEIAEFEWWLQTYKGKGNPEVEALRKEAAAIRDELQAYRHN

SEQ ID NO: 533 - protein, 73 aa, ARTIFICIAL SEQUENCE
  synthetic construct
MGSWAEFKQRLAAIKTRLEALGGSEAELAAFMDEIMAFEWELWAYKGKGNPEVEALMNEAFAIDVELYAYRHN

SEQ ID NO: 534 - protein, 73 aa, ARTIFICIAL SEQUENCE
  synthetic construct
MGSWAEFKQRLAAIKTRLEALGGSEAELAAFEWEIVAFFSELFAYKGKGNPEVEALRDEAIAIETELVAYRHN

SEQ ID NO: 535 - protein, 73 aa, ARTIFICIAL SEQUENCE
  synthetic construct
MGSWWEFDHRLTAIDTRLQALGGSEAELAEFESSIAEFEWWLQDYKGKGNPEVEALFAEAEAIYVELDAYRHN

SEQ ID NO: 536 - protein, 73 aa, ARTIFICIAL SEQUENCE
  synthetic construct
MGSWWEFQFRLYAIDQRLLALGGSEAELAEFEQDIADFEWMLQDYKGKGNPEVEALMLEADAIEAELKAYRHN

SEQ ID NO: 537 - protein, 73 aa, ARTIFICIAL SEQUENCE
  synthetic construct
MGSWYEFDHRLDAIYQRLWALGGSEAELAEFEYGIAEFEEYLQDYKGKGNPEVEALISEAWAIEWELSAYRHN

SEQ ID NO: 538 - protein, 73 aa, ARTIFICIAL SEQUENCE
  synthetic construct
MGSWYEFDMRLDAIWERLTALGGSEAELADFEQYIAEFERQLQDYKGKGNPEVEALFDEAWAIEDELYAYRHN

SEQ ID NO: 539 - protein, 73 aa, ARTIFICIAL SEQUENCE
  synthetic construct
MGSWSEFDSRLDAIAYRLFALGGSEAELAQFEWIIADFEEDLQMYKGKGNPEVEALFSEAYAIEIELNAYRHN

SEQ ID NO: 540 - protein, 73 aa, ARTIFICIAL SEQUENCE
  synthetic construct
MGSWYEFDDRLDAIAYRLNALGGSEAELAWFEWEIAEFELDLQWYKGKGNPEVEALVWEADAIEWELEAYRHN

SEQ ID NO: 541 - protein, 73 aa, ARTIFICIAL SEQUENCE
  synthetic construct
MGSWFEFDERLDAIGSRLTALGGSEAELASFEFYIADFEEWLQQYKGKGNPEVEALEWEAFAIDEELGAYRHN

SEQ ID NO: 542 - protein, 73 aa, ARTIFICIAL SEQUENCE
  synthetic construct
MGSWEEFDQRLDAIDVRLYALGGSEAELAEFEFDIAAFEEWLQLYKGKGNPEVEALNMEAFAITDELCAYRHN

SEQ ID NO: 543 - protein, 73 aa, ARTIFICIAL SEQUENCE
  synthetic construct
MGSWEEFDVRLDAIFNRLWALGGSEAELAEFEFDIAWFEMDLQEYKGKGNPEVEALFDEAEAITNELVAYRHN

SEQ ID NO: 544 - protein, 73 aa, ARTIFICIAL SEQUENCE
  synthetic construct
MGSWEEFDKRLDAITRRLMALGGSEAELAEFESTIAWFEWDLQEYKGKGNPEVEALDWEAYAIDYELGAYRHN

SEQ ID NO: 545 - protein, 73 aa, ARTIFICIAL SEQUENCE
  synthetic construct
MGSWYEFDHRLEAIYDRLWALGGSEAELAFFEFDIADFEWDLQSYKGKGNPEVEALFDEAAAIGHELLAYRHN

SEQ ID NO: 546 - protein, 73 aa, ARTIFICIAL SEQUENCE
  synthetic construct
MGSWNEFDDRLLAIWGRLDALGGSEAELAFFEEQIAGFEDELQWYKGKGNPEVEALDQEAEAIEKELWAYRHN

SEQ ID NO: 547 - protein, 73 aa, ARTIFICIAL SEQUENCE
  synthetic construct
MGSWVEFDDRLDAIWERLDALGGSEAELAWFEEQIAVFEHQLQDYKGKGNPEVEALNQEAEAIDLELKAYRHN

SEQ ID NO: 548 - protein, 73 aa, ARTIFICIAL SEQUENCE
  synthetic construct
MGSWTEFDDRLFAIYWRLDALGGSEAELAWFEEVIAEFENDLQVYKGKGNPEVEALDDEAHAISIELEAYRHN

SEQ ID NO: 549 - protein, 73 aa, ARTIFICIAL SEQUENCE
  synthetic construct
MGSWSEFDQRLEAIWNRLDALGGSEAELADFEREIAYFENQLQWYKGKGNPEVEALNNEAFAIVDELGAYRHN

SEQ ID NO: 550 - protein, 73 aa, ARTIFICIAL SEQUENCE
  synthetic construct
MGSWYEFDERLWAIWERLDALGGSEAELAHFEWVIADFENDLQWYKGKGNPEVEALEFEAEAIVTELHAYRHN

SEQ ID NO: 551 - protein, 73 aa, ARTIFICIAL SEQUENCE
  synthetic construct
MGSWMEFDYRLEAIWMRLIALGGSEAELADFESSIADFEHHLQSYKGKGNPEVEALEWEAFAIGVELDAYRHN

SEQ ID NO: 552 - protein, 73 aa, ARTIFICIAL SEQUENCE
  synthetic construct
MGSWYEFESRLEAIWWRLEALGGSEAELAQFEQYIADFEQHLQWYKGKGNPEVEALDWEADAIWLELQAYRHN

SEQ ID NO: 553 - protein, 73 aa, ARTIFICIAL SEQUENCE
  synthetic construct
MGSWEEFYMRLVAIHMRLRALGGSEAELAVFENYIAEFEEYLQYYKGKGNPEVEALTIEADAIGTELGAYRHN

SEQ ID NO: 554 - protein, 73 aa, ARTIFICIAL SEQUENCE
  synthetic construct
MGSWDEFYYRLVAITHRLHALGGSEAELAWFEDDIAGFEWDLQTYKGKGNPEVEALYKEAGAIGMELTAYRHN

SEQ ID NO: 555 - protein, 73 aa, ARTIFICIAL SEQUENCE
  synthetic construct
MGSWEEFDTRLLAIFGRLGALGGSEAELALFEMLIAKFEDDLQNYKGKGNPEVEALSEEAFAIDHELGAYRHN

SEQ ID NO: 556 - protein, 73 aa, ARTIFICIAL SEQUENCE
  synthetic construct
MGSWREFDQRLWAIDWRLEALGGSEAELAMFEWMIATFEDDLQWYKGKGNPEVEALYREAFAIDWELDAYRHN

SEQ ID NO: 557 - protein, 73 aa, ARTIFICIAL SEQUENCE
  synthetic construct
MGSWEEFHERLDAIDERLEALGGSEAELAFFEDDIASFEDWLQWYKGKGNPEVEALSREADAINFELEAYRHN

SEQ ID NO: 558 - protein, 73 aa, ARTIFICIAL SEQUENCE
  synthetic construct
MGSWNEFYERLEAIDRRLFALGGSEAELALFEWMIADFEDDLQMYKGKGNPEVEALINEAGAIGFELEAYRHN

SEQ ID NO: 559 - protein, 73 aa, ARTIFICIAL SEQUENCE
  synthetic construct
MGSWTEFTQRLEAIVDRLFALGGSEAELAEFENSIADFEWDLQWYKGKGNPEVEALNREAVAIDNELWAYRHN

SEQ ID NO: 560 - protein, 73 aa, ARTIFICIAL SEQUENCE
  synthetic construct
MGSWVEFIMRLDAIYERLDALGGSEAELAEFEWHIADFEDHLQWYKGKGNPEVEALFEEADAIWEELWAYRHN

SEQ ID NO: 561 - protein, 73 aa, ARTIFICIAL SEQUENCE
  synthetic construct
MGSWNEFLLRLDAIEHRLFALGGSEAELAEFEWEIADFEDDLQWYKGKGNPEVEALVEEAEAIDVELVAYRHN

SEQ ID NO: 562 - protein, 73 aa, ARTIFICIAL SEQUENCE
  synthetic construct
MGSWYEFNMRLGAIDDRLQALGGSEAELAWFEDMIAIFEDDLQIYKGKGNPEVEALEQEAAAIHQELWAYRHN

SEQ ID NO: 563 - protein, 73 aa, ARTIFICIAL SEQUENCE
  synthetic construct
MGSWEEFHWRLGAIDARLEALGGSEAELAWFEDGIADFEAILQDYKGKGNPEVEALDSEAVAIHHELWAYRHN

SEQ ID NO: 564 - protein, 73 aa, ARTIFICIAL SEQUENCE
  synthetic construct
MGSWYEFYERLWAIDDRLWALGGSEAELAEFEDSIATFEPSLQMYKGKGNPEVEALVAEAWAIFDELAAYRHN

SEQ ID NO: 565 - protein, 73 aa, ARTIFICIAL SEQUENCE
  synthetic construct
MGSWFEFDQRLDAITFRLWALGGSEAELAEFEDVIALFEYHLQDYKGKGNPEVEALEVEAWAIFHELGAYRHN

SEQ ID NO: 566 - protein, 73 aa, ARTIFICIAL SEQUENCE
  synthetic construct
MGSWSEFWFRLDAIEDRLWALGGSEAELAEFEDNIALFEYSLQHYKGKGNPEVEALVKEANAIDDELGAYRHN

SEQ ID NO: 567 - protein, 73 aa, ARTIFICIAL SEQUENCE
  synthetic construct
MGSWYEFWDRLTAIEHRLWALGGSEAELAYFEDSIAHFEGSLQVYKGKGNPEVEALYKEAEAIEWELEAYRHN

SEQ ID NO: 568 - protein, 73 aa, ARTIFICIAL SEQUENCE
  synthetic construct
MGSWYEFDDRLWAIFDRLFALGGSEAELAFFEDSIAEFEEELQHYKGKGNPEVEALYLEAWAIENELGAYRHN

SEQ ID NO: 569 - protein, 73 aa, ARTIFICIAL SEQUENCE
  synthetic construct
MGSWNEFVERLSAIDHRLWALGGSEAELADFEQQIAEFEIHLQEYKGKGNPEVEALDFEADAIFDELLAYRHN

SEQ ID NO: 570 - protein, 73 aa, ARTIFICIAL SEQUENCE
  synthetic construct
MGSWSEFVDRLDAIFDRLWALGGSEAELAWFEDTIAHFEWNLQEYKGKGNPEVEALNGEADAITDELHAYRHN

SEQ ID NO: 571 - protein, 73 aa, ARTIFICIAL SEQUENCE
  synthetic construct
MGSWAEFDSRLDAIAQRLFALGGSEAELAHFEDFIAQFEYSLQEYKGKGNPEVEALSNEADAIFNELKAYRHN

SEQ ID NO: 572 - protein, 73 aa, ARTIFICIAL SEQUENCE
  synthetic construct
MGSWAEFDSRLIAIFDRLWALGGSEAELAWFEDDIAQFEQHLQAYKGKGNPEVEALRQEADAITFELKAYRHN

SEQ ID NO: 573 - protein, 73 aa, ARTIFICIAL SEQUENCE
  synthetic construct
MGSWTEFEERLEAIWDRLYALGGSEAELAAFEWDIAYFEDGLQEYKGKGNPEVEALFMEAEAIIRELKAYRHN

SEQ ID NO: 574 - protein, 73 aa, ARTIFICIAL SEQUENCE
  synthetic construct
MGSWYEFEDRLAAIWDRLNALGGSEAELAIFEWDIAWFEEGLQEYKGKGNPEVEALKHEASAIQTELFAYRHN

SEQ ID NO: 575 - protein, 73 aa, ARTIFICIAL SEQUENCE
  synthetic construct
MGSWLEFESRLWAIWDRLDALGGSEAELAHFEQDIADFEMSLQEYKGKGNPEVEALIREAEAIETELYAYRHN

SEQ ID NO: 576 - protein, 73 aa, ARTIFICIAL SEQUENCE
  synthetic construct
MGSWMEFEDRLIAIWARLDALGGSEAELAWFEADIADFEESLQEYKGKGNPEVEALIFEAIAINKELMAYRHN

SEQ ID NO: 577 - protein, 73 aa, ARTIFICIAL SEQUENCE
  synthetic construct
MGSWFEFTIRLEAIQDRLDALGGSEAELAWFEWDIAEFEEGLQFYKGKGNPEVEALHTEADAIMNELVAYRHN

SEQ ID NO: 578 - protein, 73 aa, ARTIFICIAL SEQUENCE
  synthetic construct
MGSWYEFVSRLDAIEYRLWALGGSEAELAWFEWDIADFEQGLQFYKGKGNPEVEALAQEANAIGSELTAYRHN

SEQ ID NO: 579 - protein, 73 aa, ARTIFICIAL SEQUENCE
  synthetic construct
MGSWEEFDYRLYAIQDRLYALGGSEAELAFFEWEIADFEHMLQMYKGKGNPEVEALFQEADAIDAELHAYRHN

SEQ ID NO: 580 - protein, 73 aa, ARTIFICIAL SEQUENCE
  synthetic construct
MGSWIEFFHRLDAIQDRLDALGGSEAELAYFEWAIADFEHMLQLYKGKGNPEVEALQFEAFAIEGELYAYRHN

SEQ ID NO: 581 - protein, 73 aa, ARTIFICIAL SEQUENCE
  synthetic construct
MGSWYEFSSRLNAIDDRLWALGGSEAELAYFETDIADFESLLQWYKGKGNPEVEALLNEADAIDYELYAYRHN

SEQ ID NO: 582 - protein, 73 aa, ARTIFICIAL SEQUENCE
  synthetic construct
MGSWFEFEYRLDAIIDRLFALGGSEAELAEFESMIANFEYSLQEYKGKGNPEVEALYFEADAIVDELTAYRHN

SEQ ID NO: 583 - protein, 73 aa, ARTIFICIAL SEQUENCE
  synthetic construct
MGSWLEFEYRLDAIYDRLFALGGSEAELAAFEQDIADFEKYLQYYKGKGNPEVEALWEEADAIMWELFAYRHN

SEQ ID NO: 584 - protein, 73 aa, ARTIFICIAL SEQUENCE
  synthetic construct
MGSWHEFEERLMAIEDRLWALGGSEAELAEFEQWIALFEYDLQEYKGKGNPEVEALGMEAFAINNELSAYRHN

SEQ ID NO: 585 - protein, 73 aa, ARTIFICIAL SEQUENCE
  synthetic construct
MGSWYEFEERLDAIEDRLIALGGSEAELAIFEDIIAFFEQDLQYYKGKGNPEVEALEMEAEAISIELDAYRHN

SEQ ID NO: 586 - protein, 73 aa, ARTIFICIAL SEQUENCE
  synthetic construct
MGSWHEFEKRLYAIEDRLIALGGSEAELAWFEDSIAWFEWDLQMYKGKGNPEVEALNEEADAIYQELDAYRHN

SEQ ID NO: 587 - protein, 73 aa, ARTIFICIAL SEQUENCE
  synthetic construct
MGSWIEFEDRLDAITDRLWALGGSEAELAEFEHQIAFFEEDLQWYKGKGNPEVEALHMEAEAIMEELGAYRHN

SEQ ID NO: 588 - protein, 73 aa, ARTIFICIAL SEQUENCE
  synthetic construct
MGSWMEFEDRLMAIVDRLWALGGSEAELADFEWNIAMFEEELQWYKGKGNPEVEALGDEAEAIEWELYAYRHN

SEQ ID NO: 589 - protein, 73 aa, ARTIFICIAL SEQUENCE
  synthetic construct
MGSWEEFEDRLFAIDSRLWALGGSEAELAEFENIIASFEEVLQEYKGKGNPEVEALSVEAFAIDRELGAYRHN

SEQ ID NO: 590 - protein, 73 aa, ARTIFICIAL SEQUENCE
  synthetic construct
MGSWEEFLFRLEAIQDRLWALGGSEAELAWFEYEIASFEDVLQSYKGKGNPEVEALSTEAKAIDYELFAYRHN

SEQ ID NO: 591 - protein, 73 aa, ARTIFICIAL SEQUENCE
  synthetic construct
MGSWVEFDNRLFAIDERLWALGGSEAELAWFEEEIASFEDNLQKYKGKGNPEVEALQLEAFAIMEELDAYRHN

SEQ ID NO: 592 - protein, 73 aa, ARTIFICIAL SEQUENCE
  synthetic construct
MGSWFEFDDRLEAIFDRLWALGGSEAELAMFEFAIAEFEDALQEYKGKGNPEVEALYEEAVAIDEELYAYRHN

SEQ ID NO: 593 - protein, 73 aa, ARTIFICIAL SEQUENCE
  synthetic construct
MGSWFEFDARLMAINDRLWALGGSEAELAAFEYHIALFEDQLQMYKGKGNPEVEALTLEAVAINEELWAYRHN

SEQ ID NO: 594 - protein, 73 aa, ARTIFICIAL SEQUENCE
  synthetic construct
MGSWVEFDSRLAAIDYRLEALGGSEAELAWFEYTIANFEHTLQMYKGKGNPEVEALVYEAHAIATELQAYRHN

SEQ ID NO: 595 - protein, 73 aa, ARTIFICIAL SEQUENCE
  synthetic construct
MGSWTEFDERLDAIDWRLEALGGSEAELAWFEGDIALFEQYLQVYKGKGNPEVEALMEEADAIKAELDAYRHN

SEQ ID NO: 596 - protein, 73 aa, ARTIFICIAL SEQUENCE
  synthetic construct
MGSWIEFDERLDAIDFRLWALGGSEAELAWFEGWIAEFESDLQLYKGKGNPEVEALNEEANAIFHELSAYRHN

SEQ ID NO: 597 - protein, 73 aa, ARTIFICIAL SEQUENCE
  synthetic construct
MGSWWEFDSRLDAIDFRLWALGGSEAELAWFEVEIADFEDWLQLYKGKGNPEVEALWHEADAIVTELYAYRHN

SEQ ID NO: 598 - protein, 73 aa, ARTIFICIAL SEQUENCE
  synthetic construct
MGSWYEFDERLDAIFDRLWALGGSEAELAYFEQVIATFEKTLQRYKGKGNPEVEALDTEAKAISWELDAYRHN

SEQ ID NO: 599 - protein, 73 aa, ARTIFICIAL SEQUENCE
  synthetic construct
MGSWYEFQERLDAIDSRLWALGGSEAELAWFEYTIAEFEKELQMYKGKGNPEVEALGTEAVAISEELMAYRHN

SEQ ID NO: 600 - protein, 73 aa, ARTIFICIAL SEQUENCE
  synthetic construct
MGSWEEFEDRLWAIDGRLYALGGSEAELAWFEQWIATFEEDLQDYKGKGNPEVEALEYEASAIFEELEAYRHN

SEQ ID NO: 601 - protein, 73 aa, ARTIFICIAL SEQUENCE
  synthetic construct
MGSWFEFGDRLEAIDERLYALGGSEAELAQFEWWIAEFEHHLQDYKGKGNPEVEALEYEADAIWGELHAYRHN

SEQ ID NO: 602 - protein, 73 aa, ARTIFICIAL SEQUENCE
  synthetic construct
MGSWFEFNDRLDAISERLSALGGSEAELAYFEWQIAVFEKTLQNYKGKGNPEVEALTLEANAIFEELEAYRHN

SEQ ID NO: 603 - protein, 73 aa, ARTIFICIAL SEQUENCE
  synthetic construct
MGSWVEFMDRLEAIEERLSALGGSEAELAFFEWEIAEFEEHLQVYKGKGNPEVEALEWEALAITEELAAYRHN

SEQ ID NO: 604 - protein, 73 aa, ARTIFICIAL SEQUENCE
  synthetic construct
MGSWIEFMDRLWAIDQRLWALGGSEAELAWFEEEIAWFEEELQVYKGKGNPEVEALEWEATAISEELWAYRHN

SEQ ID NO: 605 - protein, 73 aa, ARTIFICIAL SEQUENCE
  synthetic construct
MGSWEEFNWRLRAIDERLFALGGSEAELAWFEYDIAEFEEQLQVYKGKGNPEVEALRVEAAAIAEELYAYRHN

SEQ ID NO: 606 - protein, 73 aa, ARTIFICIAL SEQUENCE
  synthetic construct
MGSWWEFEIRLDAIDERLWALGGSEAELAWFEQSIAFFENDLQVYKGKGNPEVEALRWEANAIIEELFAYRHN

SEQ ID NO: 607 - protein, 73 aa, ARTIFICIAL SEQUENCE
  synthetic construct
MGSWYEFEWRLDAIDRRLWALGGSEAELADFEEEIADFEWMLQNYKGKGNPEVEALVDEASAIQTELWAYRHN

SEQ ID NO: 608 - protein, 73 aa, ARTIFICIAL SEQUENCE
  synthetic construct
MGSWYEFVYRLRAIDERLDALGGSEAELAMFEFEIAFFEDQLQRYKGKGNPEVEALVDEAQAIDFELFAYRHN

SEQ ID NO: 609 - protein, 73 aa, ARTIFICIAL SEQUENCE
  synthetic construct
MGSWWEFEDRLYAIDDRLWALGGSEAELAQFEREIAQFEIWLQEYKGKGNPEVEALDDEATAINSELFAYRHN

SEQ ID NO: 610 - protein, 73 aa, ARTIFICIAL SEQUENCE
  synthetic construct
MGSWDEFEFRLEAIDSRLWALGGSEAELAVFEYEIAQFEFMLQEYKGKGNPEVEALGMEAWAIENELFAYRHN

SEQ ID NO: 611 - protein, 73 aa, ARTIFICIAL SEQUENCE
  synthetic construct
MGSWEEFEWRLDAIDERLWALGGSEAELATFEYEIAIFENELQQYKGKGNPEVEALDSEAYAIERELGAYRHN

SEQ ID NO: 612 - protein, 73 aa, ARTIFICIAL SEQUENCE
  synthetic construct
MGSWYEFFDRLDAIDERLWALGGSEAELAWFEAEIAEFEMELQGYKGKGNPEVEALDVEAHAIEMELFAYRHN

SEQ ID NO: 613 - protein, 73 aa, ARTIFICIAL SEQUENCE
  synthetic construct
MGSWYEFMGRLEAIDERLQALGGSEAELAWFEHEIAEFEWSLQWYKGKGNPEVEALRFEAGAIPWELWAYRHN

SEQ ID NO: 614 - protein, 73 aa, ARTIFICIAL SEQUENCE
  synthetic construct
MGSWVEFSNRLDAIWERLQALGGSEAELAYFEWEIAEFEWELQSYKGKGNPEVEALNAEADAIEWELEAYRHN

SEQ ID NO: 615 - protein, 73 aa, ARTIFICIAL SEQUENCE
  synthetic construct
MGSWEEFHMRLIAIDERLWALGGSEAELAGFEESIAYFESQLQDYKGKGNPEVEALDYEAHAIWRELYAYRHN

SEQ ID NO: 616 - protein, 73 aa, ARTIFICIAL SEQUENCE
  synthetic construct
MGSWWEFKYRLDAICFRLAALGGSEAELASFEDEIAYFEEDLQGYKGKGNPEVEALDYEALAIWDELAAYRHN

SEQ ID NO: 617 - protein, 73 aa, ARTIFICIAL SEQUENCE
  synthetic construct
MGSWDEFAMRLEAIQARLFALGGSEAELAIFEDEIAFFETMLQDYKGKGNPEVEALEYEAAAIEAELGAYRHN

SEQ ID NO: 618 - protein, 73 aa, ARTIFICIAL SEQUENCE
  synthetic construct
MGSWWEFNARLDAIEDRLMALGGSEAELAYFEDIIASFENILQQYKGKGNPEVEALWYEAYAIEKELNAYRHN

SEQ ID NO: 619 - protein, 73 aa, ARTIFICIAL SEQUENCE
  synthetic construct
MGSWIEFWNRLEAIEERLYALGGSEAELAYFEDEIAEFEIYLQQYKGKGNPEVEALKHEAEAINKELMAYRHN

SEQ ID NO: 620 - protein, 73 aa, ARTIFICIAL SEQUENCE
  synthetic construct
MGSWNEFVIRLFAIDDRLYALGGSEAELAWFEDEIATFEYELQRYKGKGNPEVEALEYEAEAIVSELFAYRHN

SEQ ID NO: 621 - protein, 73 aa, ARTIFICIAL SEQUENCE
  synthetic construct
MGSWYEFLARLYAIDERLWALGGSEAELATFEHWIADFEEQLQSYKGKGNPEVEALTDEAVAIGEELSAYRHN

SEQ ID NO: 622 - protein, 73 aa, ARTIFICIAL SEQUENCE
  synthetic construct
MGSWLEFETRLHAIDERLWALGGSEAELAEFEEHIAWFEEDLQFYKGKGNPEVEALDFEADAIGWELWAYRHN

SEQ ID NO: 623 - protein, 73 aa, ARTIFICIAL SEQUENCE
  synthetic construct
MGSWFEFETRLEAIDLRLWALGGSEAELATFEDVIAFFEDWLQFYKGKGNPEVEALKMEAWAIGEELHAYRHN

SEQ ID NO: 624 - protein, 73 aa, ARTIFICIAL SEQUENCE
  synthetic construct
MGSWHEFWQRLEAIEGRLWALGGSEAELADFESLIADFEEQLQEYKGKGNPEVEALMAEAEAIDNELRAYRHN

SEQ ID NO: 625 - protein, 73 aa, ARTIFICIAL SEQUENCE
  synthetic construct
MGSWYEFEQRLEAIEWRLGALGGSEAELATFEEDIADFEEWLQEYKGKGNPEVEALQYEAYAIAEELHAYRHN

SEQ ID NO: 626 - protein, 73 aa, ARTIFICIAL SEQUENCE
  synthetic construct
MGSWYEFENRLFAIEERLWALGGSEAELAWFEYEIANFEWGLQSYKGKGNPEVEALDNEAEAIDIELAAYRHN

SEQ ID NO: 627 - protein, 73 aa, ARTIFICIAL SEQUENCE
  synthetic construct
MGSWYEFEQRLGAIEERLWALGGSEAELAAFEDIIAYFEYQLQSYKGKGNPEVEALDEEAWAIDDELWAYRHN

SEQ ID NO: 628 - protein, 73 aa, ARTIFICIAL SEQUENCE
  synthetic construct
MGSWWEFEQRLDAIETRLWALGGSEAELAYFEHIIADFEDELQIYKGKGNPEVEALGWEAFAIDGELTAYRHN

SEQ ID NO: 629 - protein, 73 aa, ARTIFICIAL SEQUENCE
  synthetic construct
MGSWFEFPYRLEAIEERLYALGGSEAELAQFEQFIAWFEMDLQDYKGKGNPEVEALWFEANAIVEELDAYRHN

SEQ ID NO: 630 - protein, 73 aa, ARTIFICIAL SEQUENCE
  synthetic construct
MGSWVEFYDRLEAIEIRLWALGGSEAELADFESFIAHFEDDLQAYKGKGNPEVEALMDEANAIVFELDAYRHN

SEQ ID NO: 631 - protein, 73 aa, ARTIFICIAL SEQUENCE
  synthetic construct
MGSWVEFWDRLDAIEERLWALGGSEAELAEFEFMIAMFEQHLQEYKGKGNPEVEALIPEAGAIDKELTAYRHN

SEQ ID NO: 632 - protein, 73 aa, ARTIFICIAL SEQUENCE
  synthetic construct
MGSWDEFDARLWAIEERLWALGGSEAELAEFEFMIAAFEDVLQEYKGKGNPEVEALMGEANAIVMELDAYRHN

SEQ ID NO: 633 - protein, 73 aa, ARTIFICIAL SEQUENCE
  synthetic construct
MGSWYEFWRRLDAIEERLWALGGSEAELAMFETDIAGFEWMLQLYKGKGNPEVEALEHEAWAINSELDAYRHN

SEQ ID NO: 634 - protein, 73 aa, ARTIFICIAL SEQUENCE
  synthetic construct
MGSWHEFIWRLDAIEERLWALGGSEAELAWFETEIATFEAQLQDYKGKGNPEVEALEWEAIAIAWELDAYRHN

SEQ ID NO: 635 - protein, 73 aa, ARTIFICIAL SEQUENCE
  synthetic construct
MGSWYEFYWRLEAIEERLWALGGSEAELAEFEKAIATFEDQLQTYKGKGNPEVEALETEALAIHAELEAYRHN

SEQ ID NO: 636 - protein, 73 aa, ARTIFICIAL SEQUENCE
  synthetic construct
MGSWFEFQWRLEAIEDRLWALGGSEAELAEFETIIAGFEEQLQVYKGKGNPEVEALEEEAMAIQTELHAYRHN

SEQ ID NO: 637 - protein, 73 aa, ARTIFICIAL SEQUENCE
  synthetic construct
MGSWWEFEDRLWAIEQRLDALGGSEAELAVFENSIAKFEDMLQVYKGKGNPEVEALHEEADAIIWELYAYRHN

SEQ ID NO: 638 - protein, 73 aa, ARTIFICIAL SEQUENCE
  synthetic construct
MGSWWEFEDRLWAIDRRLMALGGSEAELAVFEQMIAHFEQILQVYKGKGNPEVEALHFEAHAIGMELAAYRHN

SEQ ID NO: 639 - protein, 73 aa, ARTIFICIAL SEQUENCE
  synthetic construct
MGSWWEFLDRLEAIEYRLQALGGSEAELAVFEWEIAMFEDHLQGYKGKGNPEVEALHSEAHAIISELSAYRHN

SEQ ID NO: 640 - protein, 73 aa, ARTIFICIAL SEQUENCE
  synthetic construct
MGSWAEFEDRLAAIERRLEALGGSEAELADFESSIAWFEPDLQYYKGKGNPEVEALMYEAEAIFSELYAYRHN

SEQ ID NO: 641 - protein, 73 aa, ARTIFICIAL SEQUENCE
  synthetic construct
MGSWWEFYDRLTAIEARLWALGGSEAELADFEEGIADFEYDLQDYKGKGNPEVEALFWEAWAIQSELTAYRHN

SEQ ID NO: 642 - protein, 73 aa, ARTIFICIAL SEQUENCE
  synthetic construct
MGSWYEFEDRLAAIEARLWALGGSEAELADFEEEIAYFEHGLQWYKGKGNPEVEALESEAMAIIDELHAYRHN

SEQ ID NO: 643 - protein, 73 aa, ARTIFICIAL SEQUENCE
  synthetic construct
MGSWWEFSWRLEAIETRLDALGGSEAELAFFEMDIAWFEQDLQLYKGKGNPEVEALEEEAYAIYEELEAYRHN

SEQ ID NO: 644 - protein, 73 aa, ARTIFICIAL SEQUENCE
  synthetic construct
MGSWEEFFFRLEAIDDRLYALGGSEAELALFEEVIAYFEQDLQWYKGKGNPEVEALYVEAYAIQEELYAYRHN

SEQ ID NO: 645 - protein, 73 aa, ARTIFICIAL SEQUENCE
  synthetic construct
MGSWFEFEERLNAISWRLHALGGSEAELAYFEEDIAWFEDDLQFYKGKGNPEVEALENEAYAIWEELDAYRHN

SEQ ID NO: 646 - protein, 73 aa, ARTIFICIAL SEQUENCE
  synthetic construct
MGSWFEFEERLEAIIYRLWALGGSEAELAMFEESIAWFESDLQQYKGKGNPEVEALEYEAMAISKELKAYRHN

SEQ ID NO: 647 - protein, 73 aa, ARTIFICIAL SEQUENCE
  synthetic construct
MGSWAEFDDRLEAIEYRLHALGGSEAELAWFEEGIAGFEHALQSYKGKGNPEVEALETEAGAINEELWAYRHN

SEQ ID NO: 648 - protein, 73 aa, ARTIFICIAL SEQUENCE
  synthetic construct
MGSWDEFEERLQAIEYRLWALGGSEAELAWFEEVIAQFEYDLQKYKGKGNPEVEALSTEAQAIQDELWAYRHN

SEQ ID NO: 649 - protein, 73 aa, ARTIFICIAL SEQUENCE
  synthetic construct
MGSWWEFTDRLDAIFDRLWALGGSEAELAAFEESIAIFEQDLQYYKGKGNPEVEALEYEANAIQYELEAYRHN

SEQ ID NO: 650 - protein, 73 aa, ARTIFICIAL SEQUENCE
  synthetic construct
MGSWWEFTDRLEAIEDRLWALGGSEAELAHFEDSIAQFEQELQWYKGKGNPEVEALADEADAIESELHAYRHN

SEQ ID NO: 651 - protein, 73 aa, ARTIFICIAL SEQUENCE
  synthetic construct
MGSWVEFFWRLDAIEDRLWALGGSEAELANFEFEIADFEAWLQKYKGKGNPEVEALHSEADAIQLELRAYRHN

SEQ ID NO: 652 - protein, 73 aa, ARTIFICIAL SEQUENCE
  synthetic construct
MGSWVEFYNRLDAIENRLWALGGSEAELAFFEELIAQFEFALQDYKGKGNPEVEALEDEADAIWEELMAYRHN

SEQ ID NO: 653 - protein, 73 aa, ARTIFICIAL SEQUENCE
  synthetic construct
MGSWEEFYYRLHAIDNRLWALGGSEAELAYFEWHIADFELELQDYKGKGNPEVEALSEEATAIFEELWAYRHN

SEQ ID NO: 654 - protein, 73 aa, ARTIFICIAL SEQUENCE
  synthetic construct
MGSWREFHDRLFAIDGRLWALGGSEAELANFEWDIADFEFELQDYKGKGNPEVEALSWEADAIMQELGAYRHN

SEQ ID NO: 655 - protein, 73 aa, ARTIFICIAL SEQUENCE
  synthetic construct
MGSWEEFDERLWAISDRLWALGGSEAELAYFEGEIAYFEQNLQTYKGKGNPEVEALQTEALAIDTELWAYRHN

SEQ ID NO: 656 - protein, 73 aa, ARTIFICIAL SEQUENCE
  synthetic construct
MGSWEEFEQRLWAIDDRLWALGGSEAELAFFEYEIAEFEMDLQWYKGKGNPEVEALFYEAHAINEELWAYRHN

SEQ ID NO: 657 - protein, 73 aa, ARTIFICIAL SEQUENCE
  synthetic construct
MGSWDEFHQRLAAIGDRLWALGGSEAELAYFEWEIATFEWDLQVYKGKGNPEVEALYFEATAIDEELMAYRHN

SEQ ID NO: 658 - protein, 73 aa, ARTIFICIAL SEQUENCE
  synthetic construct
MGSWVEFEYRLDAISDRLWALGGSEAELAFFENEIASFESDLQFYKGKGNPEVEALMFEAEAIDDELHAYRHN

SEQ ID NO: 659 - protein, 73 aa, ARTIFICIAL SEQUENCE
  synthetic construct
MGSWDEFDTRLDAIFSRLYALGGSEAELAMFEGEIAEFEGSLQHYKGKGNPEVEALDFEAHAIDEELWAYRHN

SEQ ID NO: 660 - protein, 73 aa, ARTIFICIAL SEQUENCE
  synthetic construct
MGSWHEFDDRLDAIMSRLDALGGSEAELATFEAEIATFEFVLQLYKGKGNPEVEALLAEAYAIDWELEAYRHN

SEQ ID NO: 661 - protein, 73 aa, ARTIFICIAL SEQUENCE
  synthetic construct
MGSWYEFFDRLDAIYDRLYALGGSEAELASFEAQIAEFEVELQSYKGKGNPEVEALEWEAWAIDEELYAYRHN

SEQ ID NO: 662 - protein, 73 aa, ARTIFICIAL SEQUENCE
  synthetic construct
MGSWFEFLYRLDAIEDRLWALGGSEAELAEFEQEIAKFESELQSYKGKGNPEVEALEWEAHAIDMELEAYRHN

SEQ ID NO: 663 - protein, 73 aa, ARTIFICIAL SEQUENCE
  synthetic construct
MGSWLEFEDRLVAIDHRLFALGGSEAELAEFEEEIALFESYLQDYKGKGNPEVEALNWEADAIHAELYAYRHN

SEQ ID NO: 664 - protein, 73 aa, ARTIFICIAL SEQUENCE
  synthetic construct
MGSWYEFESRLDAIVDRLWALGGSEAELAEFEYEIAKFEWELQDYKGKGNPEVEALNWEAGAIEFELYAYRHN

SEQ ID NO: 665 - protein, 73 aa, ARTIFICIAL SEQUENCE
  synthetic construct
MGSWYEFEDRLDAILYRLLALGGSEAELAWFERDIAFFESELQWYKGKGNPEVEALEWEAMAIDDELFAYRHN

SEQ ID NO: 666 - protein, 73 aa, ARTIFICIAL SEQUENCE
  synthetic construct
MGSWGEFMDRLEAIDYRLWALGGSEAELAWFESDIAEFEQELQMYKGKGNPEVEALWDEAMAIRDELFAYRHN

SEQ ID NO: 667 - protein, 73 aa, ARTIFICIAL SEQUENCE
  synthetic construct
MGSWEEFDDRLDAIEHRLWALGGSEAELADFEGSIAAFESWLQVYKGKGNPEVEALEAEAEAIADELWAYRHN

SEQ ID NO: 668 - protein, 73 aa, ARTIFICIAL SEQUENCE
  synthetic construct
MGSWYEFADRLDAIMDRLVALGGSEAELAYFEWEIAAFEEFLQMYKGKGNPEVEALDEEAEAIKDELMAYRHN

SEQ ID NO: 669 - protein, 73 aa, ARTIFICIAL SEQUENCE
  synthetic construct
MGSWNEFWERLDAIEWRLFALGGSEAELAFFELDIAWFEEELQWYKGKGNPEVEALIFEAHAITLELDAYRHN

SEQ ID NO: 670 - protein, 73 aa, ARTIFICIAL SEQUENCE
  synthetic construct
MGSWYEFDARLDAIEERLYALGGSEAELAAFEFEIAGFEEALQWYKGKGNPEVEALLKEAEAITDELYAYRHN

SEQ ID NO: 671 - protein, 73 aa, ARTIFICIAL SEQUENCE
  synthetic construct
MGSWDEFSERLDAIWGRLEALGGSEAELATFEFHIAEFEHELQYYKGKGNPEVEALQGEAAAIINELYAYRHN

SEQ ID NO: 672 - protein, 73 aa, ARTIFICIAL SEQUENCE
  synthetic construct
MGSWDEFWDRLDAIEDRLFALGGSEAELADFERVIAWFENDLQEYKGKGNPEVEALDNEADAIRIELHAYRHN

SEQ ID NO: 673 - protein, 73 aa, ARTIFICIAL SEQUENCE
  synthetic construct
MGSWDEFDDRLEAIVDRLFALGGSEAELAMFEFEIAQFEHQLQYYKGKGNPEVEALRDEADAIWIELDAYRHN

SEQ ID NO: 674 - protein, 73 aa, ARTIFICIAL SEQUENCE
  synthetic construct
MGSWEEFTIRLGAIYWRLFALGGSEAELANFEWFIAEFEYELQPYKGKGNPEVEALVIEANAIDGELQAYRHN

SEQ ID NO: 675 - protein, 73 aa, ARTIFICIAL SEQUENCE
  synthetic construct
MGSWFEFEWRLDAIENRLNALGGSEAELAWFEYHIAAFEDSLQHYKGKGNPEVEALEWEAHAIQSELQAYRHN

SEQ ID NO: 676 - protein, 73 aa, ARTIFICIAL SEQUENCE
  synthetic construct
MGSWYEFDDRLEAIWDRLGALGGSEAELAAFEKEIAAFESELQAYKGKGNPEVEWLRETAADIRAELQAYRHN

SEQ ID NO: 677 - protein, 73 aa, ARTIFICIAL SEQUENCE
  synthetic construct
MGSWGEFWARLEAIWIRLDALGGSEAELAAFEKEIAAFESELQAYKGKGNPEVEWLREEAADIRRSLQAYRHN

SEQ ID NO: 678 - protein, 73 aa, ARTIFICIAL SEQUENCE
  synthetic construct
MGSWIEFEVRLDAIWDRLFALGGSEAELAAFEKEIAAFESELQAYKGKGNPEVEYLRDEAADIRQSLQAYRHN

SEQ ID NO: 679 - protein, 73 aa, ARTIFICIAL SEQUENCE
  synthetic construct
MGSWTEFDRRLDAIWDRLFALGGSEAELAAFEKEIAAFESELQAYKGKGNPEVEWLREEAADIRDYLQAYRHN

SEQ ID NO: 680 - protein, 73 aa, ARTIFICIAL SEQUENCE
  synthetic construct
MGSWTEFDMRLDAIWDRLFALGGSEAELAAFEKEIAAFESELQAYKGKGNPEVEELREEAATIRGVLQAYRHN

SEQ ID NO: 681 - protein, 73 aa, ARTIFICIAL SEQUENCE
  synthetic construct
MGSWEEFHDRLMAIETRLWALGGSEAELAAFEKEIAAFESELQAYKGKGNPEVEWLRYEAADIRDYLQAYRHN

SEQ ID NO: 682 - protein, 73 aa, ARTIFICIAL SEQUENCE
  synthetic construct
MGSWVEFRDRLDAIETRLWALGGSEAELAAFEKEIAAFESELQAYKGKGNPEVEWLRYEAAEIRMVLQAYRHN

SEQ ID NO: 683 - protein, 73 aa, ARTIFICIAL SEQUENCE
  synthetic construct
MGSWMEFIDRLDAIEHRLWALGGSEAELAAFEKEIAAFESELQAYKGKGNPEVEFLREEAAEIRMYLQAYRHN

SEQ ID NO: 684 - protein, 73 aa, ARTIFICIAL SEQUENCE
  synthetic construct
MGSWTEFVWRLDAIEWRLEALGGSEAELAAFEKEIAAFESELQAYKGKGNPEVEFLREEAAEIRDWLQAYRHN

SEQ ID NO: 685 - protein, 73 aa, ARTIFICIAL SEQUENCE
  synthetic construct
MGSWVEFYDRLYAIEVRLLALGGSEAELAAFEKEIAAFESELQAYKGKGNPEVEFLRQEAAEIRDWLQAYRHN

SEQ ID NO: 686 - protein, 73 aa, ARTIFICIAL SEQUENCE
  synthetic construct
MGSWYEFYDRLDAIEWRLWALGGSEAELAAFEKEIAAFESELQAYKGKGNPEVEWLRDEAAQIRDFLQAYRHN

SEQ ID NO: 687 - protein, 73 aa, ARTIFICIAL SEQUENCE
  synthetic construct
MGSWVEFYDRLDAIEHRLDALGGSEAELAAFEKEIAAFESELQAYKGKGNPEVEWLRDEAAFIRDMLQAYRHN

SEQ ID NO: 688 - protein, 73 aa, ARTIFICIAL SEQUENCE
  synthetic construct
MGSWFEFVDRLTAIQVRLWALGGSEAELAAFEKEIAAFESELQAYKGKGNPEVEYLREEAALIRYSLQAYRHN

SEQ ID NO: 689 - protein, 73 aa, ARTIFICIAL SEQUENCE
  synthetic construct
MGSWFEFLDRLDAIEERLWALGGSEAELAAFEKEIAAFESELQAYKGKGNPEVEWLREEAAVIRDSLQAYRHN

SEQ ID NO: 690 - protein, 73 aa, ARTIFICIAL SEQUENCE
  synthetic construct
MGSWYEFMVRLDAIEERLFALGGSEAELAAFEKEIAAFESELQAYKGKGNPEVEFLREEAASIRYHLQAYRHN

SEQ ID NO: 691 - protein, 73 aa, ARTIFICIAL SEQUENCE
  synthetic construct
MGSWYEFEDRLDAIQWRLWALGGSEAELAAFEKEIAAFESELQAYKGKGNPEVEFLRESAANIRQHLQAYRHN

SEQ ID NO: 692 - protein, 73 aa, ARTIFICIAL SEQUENCE
  synthetic construct
MGSWSEFEYRLFAIENRLDALGGSEAELAAFEKEIAAFESELQAYKGKGNPEVEFLREEAAMIRQLLQAYRHN

SEQ ID NO: 693 - protein, 73 aa, ARTIFICIAL SEQUENCE
  synthetic construct
MGSWVEFEYRLDAITERLLALGGSEAELAAFEKEIAAFESELQAYKGKGNPEVEILREEAAFIRQWLQAYRHN

SEQ ID NO: 694 - protein, 73 aa, ARTIFICIAL SEQUENCE
  synthetic construct
MGSWWEFLDRLDAIEMRLFALGGSEAELAAFEKEIAAFESELQAYKGKGNPEVEYLREEAALIRNMLQAYRHN

SEQ ID NO: 695 - protein, 73 aa, ARTIFICIAL SEQUENCE
  synthetic construct
MGSWWEFEDRLDAIEYRLFALGGSEAELAAFEKEIAAFESELQAYKGKGNPEVEFLREEAAFIRIFLQAYRHN

SEQ ID NO: 696 - protein, 73 aa, ARTIFICIAL SEQUENCE
  synthetic construct
MGSWWEFESRLDAIFMRLTALGGSEAELAAFEKEIAAFESELQAYKGKGNPEVEDLREDAAFIREFLQAYRHN

SEQ ID NO: 697 - protein, 73 aa, ARTIFICIAL SEQUENCE
  synthetic construct
MGSWVEFWHRLDAIKARLNALGGSEAELAAFEKEIAAFESELQAYKGKGNPEVEDLRWYAADFRLILQAYRHN

SEQ ID NO: 698 - protein, 73 aa, ARTIFICIAL SEQUENCE
  synthetic construct
MGSWYEFYNRLSAIYARLQALGGSEAELAAFEKEIAAFESELQAYKGKGNPEVEDLRWYAADIRYMLQAYRHN

SEQ ID NO: 699 - protein, 73 aa, ARTIFICIAL SEQUENCE
  synthetic construct
MGSWYEFYDRLSAIYARLQALGGSEAELAAFEKEIAAFESELQAYKGKGNPEVEDLRWYAADIRYMLQAYRHN

SEQ ID NO: 700 - protein, 73 aa, ARTIFICIAL SEQUENCE
  synthetic construct
MGSWNEFYDRLSAIYFRLQALGGSEAELAAFEKEIAAFESELQAYKGKGNPEVEHLRWYAADIRMILQAYRHN

SEQ ID NO: 701 - protein, 73 aa, ARTIFICIAL SEQUENCE
  synthetic construct
MGSWNEFYDRLSAIYFRLQALGGFEAELAAFEKEIAAFESELQAYKGKGNPEVEHLRWYAADIRMILQAYRHN

SEQ ID NO: 702 - protein, 73 aa, ARTIFICIAL SEQUENCE
  synthetic construct
MGSWEEFYDRLGAIFARLHALGGSEAELAAFEKEIAAFESELQAYKGKGNPEVEDLRWYAADIRMILQAYRHN

SEQ ID NO: 703 - protein, 73 aa, ARTIFICIAL SEQUENCE
  synthetic construct
MGSWVEFYDRLHAIYFRLLALGGSEAELAAFEKEIAAFESELQAYKGKGNPEVEDLRWYAADIRLVLQAYRHN

SEQ ID NO: 704 - protein, 73 aa, ARTIFICIAL SEQUENCE
  synthetic construct
MGSWKEFDNRLYAIEDRLRALGGSEAELAAFEKEIAAFESELQAYKGKGNPEVEHLRWYAADIRMILQAYRHN

SEQ ID NO: 705 - protein, 73 aa, ARTIFICIAL SEQUENCE
  synthetic construct
MGSWVEFWDRLWAIEDRLWALGGSEAELAAFEKEIAAFESELQAYKGKGNPEVEHLRHYAADIRVWLQAYRHN

SEQ ID NO: 706 - protein, 73 aa, ARTIFICIAL SEQUENCE
  synthetic construct
MGSWYEFADRLWAIEDRLWALGGSEAELAAFEKEIAAFESELQAYKGKGNPEVEFLRYYAADIRWVLQAYRHN

SEQ ID NO: 707 - protein, 73 aa, ARTIFICIAL SEQUENCE
  synthetic construct
MGSWYEFEERLYAIEDRLYALGGSEAELAAFEKEIAAFESELQAYKGKGNPEVEFLRQEAADIRLMLQAYRHN

SEQ ID NO: 708 - protein, 73 aa, ARTIFICIAL SEQUENCE
  synthetic construct
MGSWTEFEWRLYAIEDRLMALGGSEAELAAFEKEIAAFESELQAYKGKGNPEVEFLRDEAADIRQYLQAYRHN

SEQ ID NO: 709 - protein, 73 aa, ARTIFICIAL SEQUENCE
  synthetic construct
MGSWIEFESRLWAIEDRLLALGGSEAELAAFEKEIAAFESELQAYKGKGNPEVEFLRLEAADIREDLQAYRHN

SEQ ID NO: 710 - protein, 73 aa, ARTIFICIAL SEQUENCE
  synthetic construct
MGSWFEFEDRLDAIWDRLWALGGSEAELAAFEKEIAAFESELQAYKGKGNPEVEFLRMDAAMIRYILQAYRHN

SEQ ID NO: 711 - protein, 73 aa, ARTIFICIAL SEQUENCE
  synthetic construct
MGSWEEFEDRLWAIEDRLWALGGSEAELAAFEKEIAAFESELQAYKGKGNPEVEILRYDAAYIREILQAYRHN

SEQ ID NO: 712 - protein, 73 aa, ARTIFICIAL SEQUENCE
  synthetic construct
MGSWIEFEDRLYAIEDRLWALGGSEAELAAFEKEIAAFESELQAYKGKGNPEVEFLRYEAAEIRYWLQAYRHN

SEQ ID NO: 713 - protein, 73 aa, ARTIFICIAL SEQUENCE
  synthetic construct
MGSWYEFWDRLEAIEDRLWALGGSEAELAAFEKEIAAFESELQAYKGKGNPEVEFLRYSAAEIRYQLQAYRHN

SEQ ID NO: 714 - protein, 73 aa, ARTIFICIAL SEQUENCE
  synthetic construct
MGSWVEFESRLAAIEHRLWALGGSEAELAAFEKEIAAFESELQAYKGKGNPEVEELREYAAEIRDWLQAYRHN

SEQ ID NO: 715 - protein, 73 aa, ARTIFICIAL SEQUENCE
  synthetic construct
MGSWWEFEHRLFAIEDRLWALGGSEAELAAFEKEIAAFESELQAYKGKGNPEVEFLRDYAAEIRDYLQAYRHN

SEQ ID NO: 716 - protein, 73 aa, ARTIFICIAL SEQUENCE
  synthetic construct
MGSWYEFDSRLMAIEDRLWALGGSEAELAAFEKEIAAFESELQAYKGKGNPEVEYLRQEAAEIRMILQAYRHN

SEQ ID NO: 717 - protein, 73 aa, ARTIFICIAL SEQUENCE
  synthetic construct
MGSWYEFEWRLMAIEDRLWALGGSEAELAAFEKEIAAFESELQAYKGKGNPEVEYLRHEAAEIRDVLQAYRHN

SEQ ID NO: 718 - protein, 73 aa, ARTIFICIAL SEQUENCE
  synthetic construct
MGSWYEFYNRLDAIEDRLWALGGSEAELAAFEKEIAAFESELQAYKGKGNPEVEYLRQEAADIRGQLQAYRHN

SEQ ID NO: 719 - protein, 73 aa, ARTIFICIAL SEQUENCE
  synthetic construct
MGSWWEFHDRLEAIEDRLWALGGSEAELAAFEKEIAAFESELQAYKGKGNPEVEYLRIEAADIRRQLQAYRHN

SEQ ID NO: 720 - protein, 73 aa, ARTIFICIAL SEQUENCE
  synthetic construct
MGSWYEFWDRLEAIEERLWALGGSEAELAAFEKEIAAFESELQAYKGKGNPEVEYLRLEAADIRRILQAYRHN

SEQ ID NO: 721 - protein, 73 aa, ARTIFICIAL SEQUENCE
  synthetic construct
MGSWYEFEERLWAIEERLYALGGSEAELAAFEKEIAAFESELQAYKGKGNPEVEYLRYEAAWIRDFLQAYRHN

SEQ ID NO: 722 - protein, 73 aa, ARTIFICIAL SEQUENCE
  synthetic construct
MGSWYEFENRLEAIEERLWALGGSEAELAAFEKEIAAFESELQAYKGKGNPEVEMLREEAAFIRDWLQAYRHN

SEQ ID NO: 723 - protein, 73 aa, ARTIFICIAL SEQUENCE
  synthetic construct
MGSWYEFEYRLEAIEDRLWALGGSEAELAAFEKEIAAFESELQAYKGKGNPEVEYLREEAAWIRVWLQAYRHN

SEQ ID NO: 724 - protein, 73 aa, ARTIFICIAL SEQUENCE
  synthetic construct
MGSWYEFENRLGAIGDRLWALGGSEAELAAFEKEIAAFESELQAYKGKGNPEVEWLRDEAAYIRAVLQAYRHN

SEQ ID NO: 725 - protein, 73 aa, ARTIFICIAL SEQUENCE
  synthetic construct
MGSWYEFEHRLDAIYDRLWALGGSEAELAAFEKEIAAFESELQAYKGKGNPEVEWLREEAAWIRLWLQAYRHN

SEQ ID NO: 726 - protein, 73 aa, ARTIFICIAL SEQUENCE
  synthetic construct
MGSWYEFEWRLDAIYDRLGALGGSEAELAAFEKEIAAFESELQAYKGKGNPEVEWLREDAAEIRALLQAYRHN

SEQ ID NO: 727 - protein, 73 aa, ARTIFICIAL SEQUENCE
  synthetic construct
MGSWVEFENRLEAIENRLWALGGSEAELAAFEKEIAAFESELQAYKGKGNPEVEWLREDAAQIRMMLQAYRHN

SEQ ID NO: 728 - protein, 73 aa, ARTIFICIAL SEQUENCE
  synthetic construct
MGSWYEFEERLEAIEDRLWALGGSEAELAAFEKEIAAFESELQAYKGKGNPEVEWLREQAAFIRTMLQAYRHN

SEQ ID NO: 729 - protein, 73 aa, ARTIFICIAL SEQUENCE
  synthetic construct
MGSWFEFEWRLEAIFDRLYALGGSEAELAAFEKEIAAFESELQAYKGKGNPEVEVLRAEAAEIRLRLQAYRHN

SEQ ID NO: 730 - protein, 73 aa, ARTIFICIAL SEQUENCE
  synthetic construct
MGSWWEFEDRLMAIYDRLYALGGSEAELAAFEKEIAAFESELQAYKGKGNPEVEYLRAEAALIRETLQAYRHN

SEQ ID NO: 731 - protein, 73 aa, ARTIFICIAL SEQUENCE
  synthetic construct
MGSWFEFEDRLYAIEDRLYALGGSEAELAAFEKEIAAFESELQAYKGKGNPEVEYLRWGAATIRDELQAYRHN

SEQ ID NO: 732 - protein, 73 aa, ARTIFICIAL SEQUENCE
  synthetic construct
MGSWIEFWDRLEAIEDRLWALGGSEAELAAFEKEIAAFESELQAYKGKGNPEVEELRDEAAWIRDSLQAYRHN

SEQ ID NO: 733 - protein, 73 aa, ARTIFICIAL SEQUENCE
  synthetic construct
MGSWFEFWDRLDAIEDRLYALGGSEAELAAFEKEIAAFESELQAYKGKGNPEVEELRDEAAWIRGTLQAYRHN

SEQ ID NO: 734 - protein, 73 aa, ARTIFICIAL SEQUENCE
  synthetic construct
MGSWEEFTDRLWAIEDRLYALGGSEAELAAFEKEIAAFESELQAYKGKGNPEVEWLRDEAAFIRKSLQAYRHN

SEQ ID NO: 735 - protein, 73 aa, ARTIFICIAL SEQUENCE
  synthetic construct
MGSWVEFVDRLEAIEDRLFALGGSEAELAAFEKEIAAFESELQAYKGKGNPEVEFLRDQAAYIRFMLQAYRHN

SEQ ID NO: 736 - protein, 73 aa, ARTIFICIAL SEQUENCE
  synthetic construct
MGSWFEFVDRLEAIEMRLFALGGSEAELAAFEKEIAAFESELQAYKGKGNPEVELLRWRAAMIRYDLQAYRHN

SEQ ID NO: 737 - protein, 73 aa, ARTIFICIAL SEQUENCE
  synthetic construct
MGSWWEFEMRLEAIEDRLFALGGSEAELAAFEKEIAAFESELQAYKGKGNPEVESLRWEAAFIRDILQAYRHN

SEQ ID NO: 738 - protein, 73 aa, ARTIFICIAL SEQUENCE
  synthetic construct
MGSWFEFEIRLEAIEDRLFALGGSEAELAAFEKEIAAFESELQAYKGKGNPEVEFLRDEAAEIRQVLQAYRHN

SEQ ID NO: 739 - protein, 73 aa, ARTIFICIAL SEQUENCE
  synthetic construct
MGSWYEFYQRLEAIEDRLFALGGSEAELAAFEKEIAAFESELQAYKGKGNPEVEWLRDEAAEIRVVLQAYRHN

SEQ ID NO: 740 - protein, 73 aa, ARTIFICIAL SEQUENCE
  synthetic construct
MGSWIEFEDRLEAIEDRLFALGGSEAELAAFEKEIAAFESELQAYKGKGNPEVEWLRQEAAEIRLMLQAYRHN

SEQ ID NO: 741 - protein, 73 aa, ARTIFICIAL SEQUENCE
  synthetic construct
MGSWHEFYDRLDAIYFRLWALGGSEAELAAFEKEIAAFESELQAYKGKGNPEVELLRLLAAEIRKELQAYRHN

SEQ ID NO: 742 - protein, 73 aa, ARTIFICIAL SEQUENCE
  synthetic construct
MGSWHEFITRLEAIDQRLWALGGSEAELAAFEKEIAAFESELQAYKGKGNPEVEYLRFWAAEIRFILQAYRHN

SEQ ID NO: 743 - protein, 73 aa, ARTIFICIAL SEQUENCE
  synthetic construct
MGSWMEFFDRLVAIDERLWALGGSEAELAAFEKEIAAFESELQAYKGKGNPEVEYLRMWAAEIRFLLQAYRHN

SEQ ID NO: 744 - protein, 73 aa, ARTIFICIAL SEQUENCE
  synthetic construct
MGSWVEFSGRLIAIDNRLWALGGSEAELAAFEKEIAAFESELQAYKGKGNPEVEYLRMWAAEIRYILQAYRHN

SEQ ID NO: 745 - protein, 73 aa, ARTIFICIAL SEQUENCE
  synthetic construct
MGSWVEFHHRLFAIDERLWALGGSEAELAAFEKEIAAFESELQAYKGKGNPEVEYLRMVAAEIRYILQAYRHN

SEQ ID NO: 746 - protein, 73 aa, ARTIFICIAL SEQUENCE
  synthetic construct
MGSWHEFMERLIAIDGRLWALGGSEAELAAFEKEIAAFESELQAYKGKGNPEVEYLRFVAAFIRDVLQAYRHN

SEQ ID NO: 747 - protein, 73 aa, ARTIFICIAL SEQUENCE
  synthetic construct
MGSWKEFIQRLDAIHYRLWALGGSEAELAAFEKEIAAFESELQAYKGKGNPEVEYLRFVAAFIRFELQAYRHN

SEQ ID NO: 748 - protein, 73 aa, ARTIFICIAL SEQUENCE
  synthetic construct
MGSWSEFIFRLDAIHSRLQALGGSEAELAAFEKEIAAFESELQAYKGKGNPEVEYLRFIAAEIRLKLQAYRHN

SEQ ID NO: 749 - protein, 73 aa, ARTIFICIAL SEQUENCE
  synthetic construct
MGSWFEFYDRLNAIDARLWALGGSEAELAAFEKEIAAFESELQAYKGKGNPEVENLRVHAAAIREWLQAYRHN

SEQ ID NO: 750 - protein, 73 aa, ARTIFICIAL SEQUENCE
  synthetic construct
MGSWLEFYDRLNAIDARLWALGGSEAELAAFEKEIAAFESELQAYKGKGNPEVENLRVHAAAIREWLQAYRHN

SEQ ID NO: 751 - protein, 73 aa, ARTIFICIAL SEQUENCE
  synthetic construct
MGSWFEFYHRLNAIDARLWALGGSEAELAAFEKEIAAFESELQAYKGKGNPEVENLRVHAAAIREWLQAYRHN

SEQ ID NO: 752 - protein, 73 aa, ARTIFICIAL SEQUENCE
  synthetic construct
MGSWFEFYDRLNAIDSRLWALGGSEAELAAFEKEIAAFESELQAYKGKGNPEVENLRVHAAAIREWLQAYRHN

SEQ ID NO: 753 - protein, 73 aa, ARTIFICIAL SEQUENCE
  synthetic construct
MGSWFEFYDRLNAIDARLWALGGSEAELAAFEKEIAAFESELQAYKGKGNPEVESLRVHAAAIREWLQAYRHN

SEQ ID NO: 754 - protein, 73 aa, ARTIFICIAL SEQUENCE
  synthetic construct
MGSWFEFYDRLNAIDARLWALGGSEAELAAFEKEIAAFESELQAYKGKGNPEVENLRDHAAAIREWLQAYRHN

SEQ ID NO: 755 - protein, 73 aa, ARTIFICIAL SEQUENCE
  synthetic construct
MGSWFEFYDRLNAIDARLWALGGSEAELAAFEKEIAAFESELQAYKGKGNPEVENLREHAAAIREWLQAYRHN

SEQ ID NO: 756 - protein, 73 aa, ARTIFICIAL SEQUENCE
  synthetic construct
MGSWFEFYDRLNAIDARLWALGGSEAELAAFEKEIAAFESELQAYKGKGNPEVENLRVHAAHIREWLQAYRHN

SEQ ID NO: 757 - protein, 73 aa, ARTIFICIAL SEQUENCE
  synthetic construct
MGSWLEFYHRLNAIDSRLWALGGSEAELAAFEKEIAAFESELQAYKGKGNPEVENLRVHAAAIREWLQAYRHN

SEQ ID NO: 758 - protein, 73 aa, ARTIFICIAL SEQUENCE
  synthetic construct
MGSWLEFYHRLNAIDSRLWALGGSEAELAAFEKEIAAFESELQAYKGKGNPEVESLRDHAAHIREWLQAYRHN

SEQ ID NO: 759 - protein, 73 aa, ARTIFICIAL SEQUENCE
  synthetic construct
MGSWFEFYHRLNAIDSRLWALGGSEAELAAFEKEIAAFESELQAYKGKGNPEVESLRDHAAHIREWLQAYRHN

SEQ ID NO: 760 - protein, 73 aa, ARTIFICIAL SEQUENCE
  synthetic construct
MGSWLEFYDRLNAIDSRLWALGGSEAELAAFEKEIAAFESELQAYKGKGNPEVESLRDHAAHIREWLQAYRHN

SEQ ID NO: 761 - protein, 73 aa, ARTIFICIAL SEQUENCE
  synthetic construct
MGSWLEFYHRLNAIDARLWALGGSEAELAAFEKEIAAFESELQAYKGKGNPEVESLRDHAAHIREWLQAYRHN

SEQ ID NO: 762 - protein, 73 aa, ARTIFICIAL SEQUENCE
  synthetic construct
MGSWLEFYHRLNAIDSRLWALGGSEAELAAFEKEIAAFESELQAYKGKGNPEVENLRDHAAHIREWLQAYRHN

SEQ ID NO: 763 - protein, 73 aa, ARTIFICIAL SEQUENCE
  synthetic construct
MGSWLEFYHRLNAIDSRLWALGGSEAELAAFEKEIAAFESELQAYKGKGNPEVESLRVHAAHIREWLQAYRHN

SEQ ID NO: 764 - protein, 73 aa, ARTIFICIAL SEQUENCE
  synthetic construct
MGSWLEFYHRLNAIDSRLWALGGSEAELAAFEKEIAAFESELQAYKGKGNPEVESLRDHAAAIREWLQAYRHN

SEQ ID NO: 765 - protein, 73 aa, ARTIFICIAL SEQUENCE
  synthetic construct
MGSWFEFYDRLNAIDARLWALGGSEAELAAFEKEIAAFESELQAYKGKGNPEVESLRDHAAHIREWLQAYRHN

SEQ ID NO: 766 - protein, 73 aa, ARTIFICIAL SEQUENCE
  synthetic construct
MGSWFEFYERLNAIDSRLWALGGSEAELAAFEKEIAAFESELQAYKGKGNPEVEKLRAHAASIRTWLQAYRHN

SEQ ID NO: 767 - protein, 73 aa, ARTIFICIAL SEQUENCE
  synthetic construct
MGSWIEFYWRLEAIDQRLWALGGSEAELAAFEKEIAAFESELQAYKGKGNPEVEDLRVHAAAIRWWLQAYRHN

SEQ ID NO: 768 - protein, 73 aa, ARTIFICIAL SEQUENCE
  synthetic construct
MGSWSEFVKRLDAIDQRLWALGGSEAELAAFEKEIAAFESELQAYKGKGNPEVESLRVHAAAIRAWLQAYRHN

SEQ ID NO: 769 - protein, 73 aa, ARTIFICIAL SEQUENCE
  synthetic construct
MGSWEEFYYRLEAIDARLFALGGSEAELAAFEKEIAAFESELQAYKGKGNPEVEELRVHAAHIRDWLQAYRHN

SEQ ID NO: 770 - protein, 73 aa, ARTIFICIAL SEQUENCE
  synthetic construct
MGSWVEFHYRLQAIDARLWALGGSEAELAAFEKEIAAFESELQAYKGKGNPEVEELRVHAAHIRKWLQAYRHN

SEQ ID NO: 771 - protein, 73 aa, ARTIFICIAL SEQUENCE
  synthetic construct
MGSWVEFVGRLNAIDARLWALGGSEAELAAFEKEIAAFESELQAYKGKGNPEVEELRHHAAEIRNWLQAYRHN

SEQ ID NO: 772 - protein, 73 aa, ARTIFICIAL SEQUENCE
  synthetic construct
MGSWNEFMDRLNAIDNRLWALGGSEAELAAFEKEIAAFESELQAYKGKGNPEVENLRKQAASIRLWLQAYRHN

SEQ ID NO: 773 - protein, 73 aa, ARTIFICIAL SEQUENCE
  synthetic construct
MGSWNEFFQRLNAIDERLWALGGSEAELAAFEKEIAAFESELQAYKGKGNPEVEDLRQHAANIRWWLQAYRHN

SEQ ID NO: 774 - protein, 73 aa, ARTIFICIAL SEQUENCE
  synthetic construct
MGSWYEFVVRLFAIDERLWALGGSEAELAAFEKEIAAFESELQAYKGKGNPEVESLREHAAHIRSWLQAYRHN

SEQ ID NO: 775 - protein, 73 aa, ARTIFICIAL SEQUENCE
  synthetic construct
MGSWYEFYLRLDAIDHRLWALGGSEAELAAFEKEIAAFESELQAYKGKGNPEVEMLREHAAHIRKWLQAYRHN

SEQ ID NO: 776 - protein, 73 aa, ARTIFICIAL SEQUENCE
  synthetic construct
MGSWYEFRARLLAIDERLWALGGSEAELAAFEKEIAAFESELQAYKGKGNPEVEHLREHAAHIRNFLQAYRHN

SEQ ID NO: 777 - protein, 73 aa, ARTIFICIAL SEQUENCE
  synthetic construct
MGSWTEFWHRLEAIDSRLWALGGSEAELAAFEKEIAAFESELQAYKGKGNPEVESLREHAAHIRVWLQAYRHN

SEQ ID NO: 778 - protein, 73 aa, ARTIFICIAL SEQUENCE
  synthetic construct
MGSWTEFQNRLNAIDHRLWALGGSEAELAAFEKEIAAFESELQAYKGKGNPEVESLREHAAKIRVWLQAYRHN

SEQ ID NO: 779 - protein, 73 aa, ARTIFICIAL SEQUENCE
  synthetic construct
MGSWSEFFKRLEAIDRRLWALGGSEAELAAFEKEIAAFESELQAYKGKGNPEVEELREHAAHIRVWLQAYRHN

SEQ ID NO: 780 - protein, 73 aa, ARTIFICIAL SEQUENCE
  synthetic construct
MGSWYEFQQRLEAIDTRLWALGGSEAELAAFEKEIAAFESELQAYKGKGNPEVEELREHAAHIRHWLQAYRHN

SEQ ID NO: 781 - protein, 73 aa, ARTIFICIAL SEQUENCE
  synthetic construct
MGSWTEFEKRLHAIDYRLWALGGSEAELAAFEKEIAAFESELQAYKGKGNPEVEDLREHAAAIRHWLQAYRHN

SEQ ID NO: 782 - protein, 73 aa, ARTIFICIAL SEQUENCE
  synthetic construct
MGSWTEFHQRLDAIDERLWALGGSEAELAAFEKEIAAFESELQAYKGKGNPEVEFLREHAAKIRMWLQAYRHN

SEQ ID NO: 783 - protein, 73 aa, ARTIFICIAL SEQUENCE
  synthetic construct
MGSWLEFSQRLTAIDSRLWALGGSEAELAAFEKEIAAFESELQAYKGKGNPEVENLREHAAKIRNWLQAYRHN

SEQ ID NO: 784 - protein, 73 aa, ARTIFICIAL SEQUENCE
  synthetic construct
MGSWTEFVNRLYAIDSRLWALGGSEAELAAFEKEIAAFESELQAYKGKGNPEVEGLRTHAAKIRHWLQAYRHN

SEQ ID NO: 785 - protein, 73 aa, ARTIFICIAL SEQUENCE
  synthetic construct
MGSWMEFVDRLSAIDRRLWALGGSEAELAAFEKEIAAFESELQAYKGKGNPEVEVLREHAANIRQWLQAYRHN

SEQ ID NO: 786 - protein, 73 aa, ARTIFICIAL SEQUENCE
  synthetic construct
MGSWVEFVSRLYAIDFRLWALGGSEAELAAFEKEIAAFESELQAYKGKGNPEVEALREHAAQIRDWLQAYRHN

SEQ ID NO: 787 - protein, 73 aa, ARTIFICIAL SEQUENCE
  synthetic construct
MGSWSEFHTRLDAIDTRLWALGGSEAELAAFEKEIAAFESELQAYKGKGNPEVEDLRRHAAAIRFWLQAYRHN

SEQ ID NO: 788 - protein, 73 aa, ARTIFICIAL SEQUENCE
  synthetic construct
MGSWLEFHSRLDAIDTRLWALGGSEAELAAFEKEIAAFESELQAYKGKGNPEVEKLREHAAAIRHYLQAYRHN

SEQ ID NO: 789 - protein, 73 aa, ARTIFICIAL SEQUENCE
  synthetic construct
MGSWTEFYQRLDAIDTRLWALGGSEAELAAFEKEIAAFESELQAYKGKGNPEVEGLRQQAAQIRAWLQAYRHN

SEQ ID NO: 790 - protein, 73 aa, ARTIFICIAL SEQUENCE
  synthetic construct
MGSWAEFSDRLNAIDQRLWALGGSEAELAAFEKEIAAFESELQAYKGKGNPEVEILREHAAEIRKFLQAYRHN

SEQ ID NO: 791 - protein, 73 aa, ARTIFICIAL SEQUENCE
  synthetic construct
MGSWMEFNHRLQAIDGRLWALGGSEAELAAFEKEIAAFESELQAYKGKGNPEVEMLREHAAAIRAFLQAYRHN

SEQ ID NO: 792 - protein, 73 aa, ARTIFICIAL SEQUENCE
  synthetic construct
MGSWYEFYKRLEAIDNRLYALGGSEAELAAFEKEIAAFESELQAYKGKGNPEVEYLREHAAAIRHWLQAYRHN

SEQ ID NO: 793 - protein, 73 aa, ARTIFICIAL SEQUENCE
  synthetic construct
MGSWYEFYYRLEAIDNRLIALGGSEAELAAFEKEIAAFESELQAYKGKGNPEVEVLREHAAKIREWLQAYRHN

SEQ ID NO: 794 - protein, 73 aa, ARTIFICIAL SEQUENCE
  synthetic construct
MGSWYEFVSRLEAIDDRLYALGGSEAELAAFEKEIAAFESELQAYKGKGNPEVEMLRQHAAAIRHWLQAYRHN

SEQ ID NO: 795 - protein, 73 aa, ARTIFICIAL SEQUENCE
  synthetic construct
MGSWYEFSHRLEAIEDRLFALGGSEAELAAFEKEIAAFESELQAYKGKGNPEVEPLREHAAYIRHWLQAYRHN

SEQ ID NO: 796 - protein, 73 aa, ARTIFICIAL SEQUENCE
  synthetic construct
MGSWFEFFERLAAIEDRLWALGGSEAELAAFEKEIAAFESELQAYKGKGNPEVESLRVHAAAIRAFLQAYRHN

SEQ ID NO: 797 - protein, 73 aa, ARTIFICIAL SEQUENCE
  synthetic construct
MGSWIEFKYRLDAIEWRLEALGGSEAELAAFEKEIAAFESELQAYKGKGNPEVESLRIHAAAIRTWLQAYRHN

SEQ ID NO: 798 - protein, 73 aa, ARTIFICIAL SEQUENCE
  synthetic construct
MGSWYEFMYRLDAIEYRLFALGGSEAELAAFEKEIAAFESELQAYKGKGNPEVESLRIHAAMIREWLQAYRHN

SEQ ID NO: 799 - protein, 73 aa, ARTIFICIAL SEQUENCE
  synthetic construct
MGSWVEFVTRLEAIEDRLFALGGSEAELAAFEKEIAAFESELQAYKGKGNPEVEHLRAHAAHIRHWLQAYRHN

SEQ ID NO: 800 - protein, 73 aa, ARTIFICIAL SEQUENCE
  synthetic construct
MGSWYEFVIRLDAIEDRLFALGGSEAELAAFEKEIAAFESELQAYKGKGNPEVEHLRVHAAHIRVWLQAYRHN

SEQ ID NO: 801 - protein, 73 aa, ARTIFICIAL SEQUENCE
  synthetic construct
MGSWVEFVERLDAIEFRLFALGGSEAELAAFEKEIAAFESELQAYKGKGNPEVEKLRNHAAHIRSWLQAYRHN

SEQ ID NO: 802 - protein, 73 aa, ARTIFICIAL SEQUENCE
  synthetic construct
MGSWSEFVHRLDAIEVRLFALGGSEAELAAFEKEIAAFESELQAYKGKGNPEVEELRYHAAKIRSWLQAYRHN

SEQ ID NO: 803 - protein, 73 aa, ARTIFICIAL SEQUENCE
  synthetic construct
MGSWSEFYYRLAAIESRLFALGGSEAELAAFEKEIAAFESELQAYKGKGNPEVERLREHAAHIRRWLQAYRHN

SEQ ID NO: 804 - protein, 73 aa, ARTIFICIAL SEQUENCE
  synthetic construct
MGSWYEFYLRLSAIEDRLFALGGSEAELAAFEKEIAAFESELQAYKGKGNPEVESLRVQAAHIRTWLQAYRHN

SEQ ID NO: 805 - protein, 73 aa, ARTIFICIAL SEQUENCE
  synthetic construct
MGSWYEFYDRLDAIEDRLFALGGSEAELAAFEKEIAAFESELQAYKGKGNPEVESLRDQAAYIRTWLQAYRHN

SEQ ID NO: 806 - protein, 73 aa, ARTIFICIAL SEQUENCE
  synthetic construct
MGSWHEFWVRLEAIESRLFALGGSEAELAAFEKEIAAFESELQAYKGKGNPEVESLRVQAAHIRSWLQAYRHN

SEQ ID NO: 807 - protein, 73 aa, ARTIFICIAL SEQUENCE
  synthetic construct
MGSWVEFYHRLEAIEQRLMALGGSEAELAAFEKEIAAFESELQAYKGKGNPEVESLREQAAAIRSWLQAYRHN

SEQ ID NO: 808 - protein, 73 aa, ARTIFICIAL SEQUENCE
  synthetic construct
MGSWVEFYERLNAIEYRLEALGGSEAELAAFEKEIAAFESELQAYKGKGNPEVESLREHAAYIRQWLQAYRHN

SEQ ID NO: 809 - protein, 73 aa, ARTIFICIAL SEQUENCE
  synthetic construct
MGSWVEFYHRLDAIFDRLDALGGSEAELAAFEKEIAAFESELQAYKGKGNPEVEELRANAAGIRSWLQAYRHN

SEQ ID NO: 810 - protein, 73 aa, ARTIFICIAL SEQUENCE
  synthetic construct
MGSWSEFTDRLFAIEDRLLALGGSEAELAAFEKEIAAFESELQAYKGKGNPEVEDLRMHAASIRLWLQAYRHN

SEQ ID NO: 811 - protein, 73 aa, ARTIFICIAL SEQUENCE
  synthetic construct
MGSWHEFYDRLYAIWDRLDALGGSEAELAAFEKEIAAFESELQAYKGKGNPEVEGLRNAAAVIRIFLQAYRHN

SEQ ID NO: 812 - protein, 73 aa, ARTIFICIAL SEQUENCE
  synthetic construct
MGSWFEFSNRLYAIWHRLTALGGSEAELAAFEKEIAAFESELQAYKGKGNPEVESLRTQAAFIRILLQAYRHN

SEQ ID NO: 813 - protein, 73 aa, ARTIFICIAL SEQUENCE
  synthetic construct
MGSWFEFSDRLYAIWERLDALGGSEAELAAFEKEIAAFESELQAYKGKGNPEVESLRFQAAFIRYQLQAYRHN

SEQ ID NO: 814 - protein, 73 aa, ARTIFICIAL SEQUENCE
  synthetic construct
MGSWFEFEDRLFAIWTRLEALGGSEAELAAFEKEIAAFESELQAYKGKGNPEVESLRQSAASIRWLLQAYRHN

SEQ ID NO: 815 - protein, 73 aa, ARTIFICIAL SEQUENCE
  synthetic construct
MGSWHEFSERLFAIWTRLEALGGSEAELAAFEKEIAAFESELQAYKGKGNPEVEALRQSAAFIRVMLQAYRHN

SEQ ID NO: 816 - protein, 73 aa, ARTIFICIAL SEQUENCE
  synthetic construct
MGSWGEFTVRLYAIDRRLDALGGSEAELAAFEKEIAAFESELQAYKGKGNPEVEELRRFAAIIRAFLQAYRHN

SEQ ID NO: 817 - protein, 73 aa, ARTIFICIAL SEQUENCE
  synthetic construct
MGSWYEFDHRLMAISFRLVALGGSEAELAAFEKEIAAFESELQAYKGKGNPEVETLRRRAANIRHLLQAYRHN

SEQ ID NO: 818 - protein, 73 aa, ARTIFICIAL SEQUENCE
  synthetic construct
MGSWSIFKYHLADIKLLLEALGGSEAELAYFEFLIADFEFTLQDYKGKGNPEVEALRKEAAAIRDELQAYRHN

SEQ ID NO: 819 - protein, 73 aa, ARTIFICIAL SEQUENCE
  synthetic construct
MGSWHHFKYFLADIKSILEALGGSEAELAIFEVQIAYFEDLLQSYKGKGNPEVEALRKEAAAIRDELQAYRHN

SEQ ID NO: 820 - protein, 73 aa, ARTIFICIAL SEQUENCE
  synthetic construct
MGSWLYFKYNLAVIKHWLEALGGSEAELAIFEMSIADFEYELQWYKGKGNPEVEALRKEAAAIRDELQAYRHN

SEQ ID NO: 821 - protein, 73 aa, ARTIFICIAL SEQUENCE
  synthetic construct
MGSWFYFKYELAWIKHWLEALGGSEAELASFETHIAFFEHQLQYYKGKGNPEVEALRKEAAAIRDELQAYRHN

SEQ ID NO: 822 - protein, 73 aa, ARTIFICIAL SEQUENCE
  synthetic construct
MGSWADFKWTLAYIKHRLEALGGSEAELAFFEMEIAYFEQSLQNYKGKGNPEVEALRKEAAAIRDELQAYRHN

SEQ ID NO: 823 - protein, 73 aa, ARTIFICIAL SEQUENCE
  synthetic construct
MGSWAYFKGQLAYIKSGLEALGGSEAELAYFELRIAYFEHWLQNYKGKGNPEVEALRKEAAAIRDELQAYRHN

SEQ ID NO: 824 - protein, 73 aa, ARTIFICIAL SEQUENCE
  synthetic construct
MGSWENFKDTLAWIKEYLEALGGSEAELAGFEHRIAIFEHYLQYYKGKGNPEVEALRKEAAAIRDELQAYRHN

SEQ ID NO: 825 - protein, 73 aa, ARTIFICIAL SEQUENCE
  synthetic construct
MGSWVLFKDYLADIKHYLEALGGSEAELANFEHLIANFEGDLQTYKGKGNPEVEALRKEAAAIRDELQAYRHN

SEQ ID NO: 826 - protein, 73 aa, ARTIFICIAL SEQUENCE
  synthetic construct
MGSWSLFKHRLANIKVYLEALGGSEAELADFETFIAYFEKDLQEYKGKGNPEVEALRKEAAAIRDELQAYRHN

SEQ ID NO: 827 - protein, 73 aa, ARTIFICIAL SEQUENCE
  synthetic construct
MGSWEHFKVELAGIKAYLEALGGSEAELALFEWAIADFESILQDYKGKGNPEVEALRKEAAAIRDELQAYRHN

SEQ ID NO: 828 - protein, 73 aa, ARTIFICIAL SEQUENCE
  synthetic construct
MGSWIYFKDELAGIKKYLEALGGSEAELAMFEVAIADFEAILQKYKGKGNPEVEALRKEAAAIRDELQAYRHN

SEQ ID NO: 829 - protein, 73 aa, ARTIFICIAL SEQUENCE
  synthetic construct
MGSWVLFKQELAWIKWLLEALGGSEAELAAFEEQIARFEHDLQKYKGKGNPEVEALRKEAAAIRDELQAYRHN

SEQ ID NO: 830 - protein, 73 aa, ARTIFICIAL SEQUENCE
  synthetic construct
MGSWVLFKQELAWIKWYLEALGGSEAELAAFEWEIAAFEQRLQIYKGKGNPEVEALRKEAAAIRDELQAYRHN

SEQ ID NO: 831 - protein, 73 aa, ARTIFICIAL SEQUENCE
  synthetic construct
MGSWFLFKSELAWIKWRLEALGGSEAELAYFEYQIAEFEFWLQSYKGKGNPEVEALRKEAAAIRDELQAYRHN

SEQ ID NO: 832 - protein, 73 aa, ARTIFICIAL SEQUENCE
  synthetic construct
MGSWLLFKSELAWIKWYLEALGGSEAELAEFEWNIAEFEKNLQKYKGKGNPEVEALRKEAAAIRDELQAYRHN

SEQ ID NO: 833 - protein, 73 aa, ARTIFICIAL SEQUENCE
  synthetic construct
MGSWLLFKSDLAWIKWRLEALGGSEAELAEFEESIAMFEHWLQEYKGKGNPEVEALRKEAAAIRDELQAYRHN

SEQ ID NO: 834 - protein, 73 aa, ARTIFICIAL SEQUENCE
  synthetic construct
MGSWLYFKSDLAWIKWRLEALGGSEAELADFEEAIAEFEQALQIYKGKGNPEVEALRKEAAAIRDELQAYRHN

SEQ ID NO: 835 - protein, 73 aa, ARTIFICIAL SEQUENCE
  synthetic construct
MGSWKLFKYELAWIKWRLEALGGSEAELADFEASIAQFEKYLQTYKGKGNPEVEALRKEAAAIRDELQAYRHN

SEQ ID NO: 836 - protein, 73 aa, ARTIFICIAL SEQUENCE
  synthetic construct
MGSWYLFKNELAWIKWRLEALGGSEAELADFEMVIAMFEDHLQEYKGKGNPEVEALRKEAAAIRDELQAYRHN

SEQ ID NO: 837 - protein, 73 aa, ARTIFICIAL SEQUENCE
  synthetic construct
MGSWVYFKAHLAFIKWELEALGGSEAELANFESTIAEFEKYLQVYKGKGNPEVEALRKEAAAIRDELQAYRHN

SEQ ID NO: 838 - protein, 73 aa, ARTIFICIAL SEQUENCE
  synthetic construct
MGSWMYFKSHLAWIKWELEALGGSEAELAFFEDNIAQFEYWLQLYKGKGNPEVEALRKEAAAIRDELQAYRHN

SEQ ID NO: 839 - protein, 73 aa, ARTIFICIAL SEQUENCE
  synthetic construct
MGSWTLFKWDLAFIKWQLEALGGSEAELAWFEYEIAAFEDSLQNYKGKGNPEVEALRKEAAAIRDELQAYRHN

SEQ ID NO: 840 - protein, 73 aa, ARTIFICIAL SEQUENCE
  synthetic construct
MGSWILFKEDLAFIKWQLEALGGSEAELAWFETTIANFESDLQKYKGKGNPEVEALRKEAAAIRDELQAYRHN

SEQ ID NO: 841 - protein, 73 aa, ARTIFICIAL SEQUENCE
  synthetic construct
MGSWYFFKSRLAYIKVYLEALGGSEAELAGFEWEIAHFEEWLQRYKGKGNPEVEALRKEAAAIRDELQAYRHN

SEQ ID NO: 842 - protein, 73 aa, ARTIFICIAL SEQUENCE
  synthetic construct
MGSWYIFKSELAWIKWYLEALGGSEAELANFEVEIATFETWLQGYKGKGNPEVEALRKEAAAIRDELQAYRHN

SEQ ID NO: 843 - protein, 73 aa, ARTIFICIAL SEQUENCE
  synthetic construct
MGSWYIFKQELASIKLSLEALGGSEAELAHFEAEIAWFEWWLQWYKGKGNPEVEALRKEAAAIRDELQAYRHN

SEQ ID NO: 844 - protein, 73 aa, ARTIFICIAL SEQUENCE
  synthetic construct
MGSWVRFKTELAYIKESLEALGGSEAELAMFESEIAIFEHSLQTYKGKGNPEVEALRKEAAAIRDELQAYRHN

SEQ ID NO: 845 - protein, 73 aa, ARTIFICIAL SEQUENCE
  synthetic construct
MGSWYLFKTELAAIKYRLEALGGSEAELASFEYEIAWFEHILQFYKGKGNPEVEALRKEAAAIRDELQAYRHN

SEQ ID NO: 846 - protein, 73 aa, ARTIFICIAL SEQUENCE
  synthetic construct
MGSWYWFKYELAEIKWHLEALGGSEAELAHFEHSIAVFESQLQQYKGKGNPEVEALRKEAAAIRDELQAYRHN

SEQ ID NO: 847 - protein, 73 aa, ARTIFICIAL SEQUENCE
  synthetic construct
MGSWWVFKKTLAEIKWTLEALGGSEAELAYFEAEIAFFEFILQQYKGKGNPEVEALRKEAAAIRDELQAYRHN

SEQ ID NO: 848 - protein, 73 aa, ARTIFICIAL SEQUENCE
  synthetic construct
MGSWVYFKDHLAEIKSQLEALGGSEAELALFEYDIAWFEFILQYYKGKGNPEVEALRKEAAAIRDELQAYRHN

SEQ ID NO: 849 - protein, 73 aa, ARTIFICIAL SEQUENCE
  synthetic construct
MGSWVYFKHRLAEIKDQLEALGGSEAELAEFETDIAWFEWMLQYYKGKGNPEVEALRKEAAAIRDELQAYRHN

SEQ ID NO: 850 - protein, 73 aa, ARTIFICIAL SEQUENCE
  synthetic construct
MGSWIIFKTDLARIKNYLEALGGSEAELATFERDIAWFEFMLQIYKGKGNPEVEALRKEAAAIRDELQAYRHN

SEQ ID NO: 851 - protein, 73 aa, ARTIFICIAL SEQUENCE
  synthetic construct
MGSWMHFKQDLAEIKGYLEALGGSEAELAIFEMDIAWFEYMLQYYKGKGNPEVEALRKEAAAIRDELQAYRHN

SEQ ID NO: 852 - protein, 73 aa, ARTIFICIAL SEQUENCE
  synthetic construct
MGSWQIFKQDLAAIKDYLEALGGSEAELAIFEFDIAWFEHMLQWYKGKGNPEVEALRKEAAAIRDELQAYRHN

SEQ ID NO: 853 - protein, 73 aa, ARTIFICIAL SEQUENCE
  synthetic construct
MGSWLAFKEDLAHIKSILEALGGSEAELAEFEHDIAWFEYMLQYYKGKGNPEVEALRKEAAAIRDELQAYRHN

SEQ ID NO: 854 - protein, 73 aa, ARTIFICIAL SEQUENCE
  synthetic construct
MGSWFVFKEDLAGIKFILEALGGSEAELAMFETDIAWFEYMLQYYKGKGNPEVEALRKEAAAIRDELQAYRHN

SEQ ID NO: 855 - protein, 73 aa, ARTIFICIAL SEQUENCE
  synthetic construct
MGSWTHFKEDLAHIKDRLEALGGSEAELAAFELDIAWFEFMLQYYKGKGNPEVEALRKEAAAIRDELQAYRHN

SEQ ID NO: 856 - protein, 73 aa, ARTIFICIAL SEQUENCE
  synthetic construct
MGSWYYFKERLAAIKDRLEALGGSEAELAIFEADIAWFEFMLQYYKGKGNPEVEALRKEAAAIRDELQAYRHN

SEQ ID NO: 857 - protein, 73 aa, ARTIFICIAL SEQUENCE
  synthetic construct
MGSWYTFKGSLAEIKNRLEALGGSEAELAMFESDIAWFEFMLQFYKGKGNPEVEALRKEAAAIRDELQAYRHN

SEQ ID NO: 858 - protein, 73 aa, ARTIFICIAL SEQUENCE
  synthetic construct
MGSWFTFKDDLAQIKNRLEALGGSEAELANFEMSIAWFEFMLQYYKGKGNPEVEALRKEAAAIRDELQAYRHN

SEQ ID NO: 859 - protein, 73 aa, ARTIFICIAL SEQUENCE
  synthetic construct
MGSWVLFKQDLAMIKQRLEALGGSEAELAMFEYDIAWFEHMLQYYKGKGNPEVEALRKEAAAIRDELQAYRHN

SEQ ID NO: 860 - protein, 73 aa, ARTIFICIAL SEQUENCE
  synthetic construct
MGSWVEFKRDLANIKQRLEALGGSEAELAQFEMQIAWFEHTLQYYKGKGNPEVEALRKEAAAIRDELQAYRHN

SEQ ID NO: 861 - protein, 73 aa, ARTIFICIAL SEQUENCE
  synthetic construct
MGSWSYFKEDLANIKSSLEALGGSEAELAWFESSIAWFEHTLQYYKGKGNPEVEALRKEAAAIRDELQAYRHN

SEQ ID NO: 862 - protein, 73 aa, ARTIFICIAL SEQUENCE
  synthetic construct
MGSWSIFKQDLADIKDSLEALGGSEAELAMFEMDIAWFEHTLQYYKGKGNPEVEALRKEAAAIRDELQAYRHN

SEQ ID NO: 863 - protein, 73 aa, ARTIFICIAL SEQUENCE
  synthetic construct
MGSWEIFKDDLASIKKVLEALGGSEAELALFESDIAWFELMLQYYKGKGNPEVEALRKEAAAIRDELQAYRHN

SEQ ID NO: 864 - protein, 73 aa, ARTIFICIAL SEQUENCE
  synthetic construct
MGSWSIFKDDLAVIKERLEALGGSEAELAHFEQDIAWFEHLLQYYKGKGNPEVEALRKEAAAIRDELQAYRHN

SEQ ID NO: 865 - protein, 73 aa, ARTIFICIAL SEQUENCE
  synthetic construct
MGSWSVFKDDLAQIKDRLEALGGSEAELAQFELDIAWFEYVLQFYKGKGNPEVEALRKEAAAIRDELQAYRHN

SEQ ID NO: 866 - protein, 73 aa, ARTIFICIAL SEQUENCE
  synthetic construct
MGSWAVFKDSLAHIKDVLEALGGSEAELALFEMDIAWFEYVLQDYKGKGNPEVEALRKEAAAIRDELQAYRHN

SEQ ID NO: 867 - protein, 73 aa, ARTIFICIAL SEQUENCE
  synthetic construct
MGSWIAFKDHLAIIKQRLEALGGSEAELARFEFEIAWFEWMLQYYKGKGNPEVEALRKEAAAIRDELQAYRHN

SEQ ID NO: 868 - protein, 73 aa, ARTIFICIAL SEQUENCE
  synthetic construct
MGSWIHFKNDLAVIKDELEALGGSEAELARFEIMIAWFEDALQWYKGKGNPEVEALRKEAAAIRDELQAYRHN

SEQ ID NO: 869 - protein, 73 aa, ARTIFICIAL SEQUENCE
  synthetic construct
MGSWMVFKQDLAEIKANLEALGGSEAELADFEFAIAWFEYELQWYKGKGNPEVEALRKEAAAIRDELQAYRHN

SEQ ID NO: 870 - protein, 73 aa, ARTIFICIAL SEQUENCE
  synthetic construct
MGSWKNFKLELALIKSKLEALGGSEAELAQFEADIAFFEWSLQWYKGKGNPEVEALRKEAAAIRDELQAYRHN

SEQ ID NO: 871 - protein, 73 aa, ARTIFICIAL SEQUENCE
  synthetic construct
MGSWHSFKQDLAYIKYLLEALGGSEAELAQFEELIAFFEYYLQTYKGKGNPEVEALRKEAAAIRDELQAYRHN

SEQ ID NO: 872 - protein, 73 aa, ARTIFICIAL SEQUENCE
  synthetic construct
MGSWVVFKSSLAQIKILLEALGGSEAELAIFEVKIAHFEQELQEYKGKGNPEVEALRKEAAAIRDELQAYRHN

SEQ ID NO: 873 - protein, 73 aa, ARTIFICIAL SEQUENCE
  synthetic construct
MGSWDQFKNSLASIKRVLEALGGSEAELAIFEVKIAHFEHFLQQYKGKGNPEVEALRKEAAAIRDELQAYRHN

SEQ ID NO: 874 - protein, 73 aa, ARTIFICIAL SEQUENCE
  synthetic construct
MGSWNNFKSSLASIKQVLEALGGSEAELAVFELQIAHFERELQYYKGKGNPEVEALRKEAAAIRDELQAYRHN

SEQ ID NO: 875 - protein, 73 aa, ARTIFICIAL SEQUENCE
  synthetic construct
MGSWVEFGHRLWAIDQRLYALGGSEAELAAFEKEIAAFESELQAYKGKGNPEVEKLRQRAAFIRFRLQAYRHN

SEQ ID NO: 876 - protein, 73 aa, ARTIFICIAL SEQUENCE
  synthetic construct
MGSWAEFKQRLAAIKTRLEALGGSEAELAAFLGEIWAFEMELAAYKGKGNPEVEALGREAAAIRMELQAYRHN

SEQ ID NO: 877 - protein, 73 aa, ARTIFICIAL SEQUENCE
  synthetic construct
MGSWYEFDLRLHAIYDRLVALGGSEAELAAFEKEIAAFESELQAYKGKGNPEVEILRDNAAYIRQMLQAYRHN

SEQ ID NO: 878 - protein, 73 aa, ARTIFICIAL SEQUENCE
  synthetic construct
MGSWHEFHDRLQAIHERLYALGGSEAELAAFEKEIAAFESELQAYKGKGNPEVESLRIAAAHIRQVLQAYRHN

SEQ ID NO: 879 - protein, 73 aa, ARTIFICIAL SEQUENCE
  synthetic construct
MGSWNYFKDHLAWIKNSLEALGGSEAELAHFETAIASFERQLQEYKGKGNPEVEALRKEAAAIRDELQAYRHN

SEQ ID NO: 880 - protein, 73 aa, ARTIFICIAL SEQUENCE
  synthetic construct
MGSWLWFKIFLAEIKYFLEALGGSEAELAAFDFEIHAFHVELFAYKGKGNPEVEVLREVAAEIRWDLQAYRHN

SEQ ID NO: 881 - protein, 73 aa, ARTIFICIAL SEQUENCE
  synthetic construct
MGSWTEFQSRLDAIHSRLRALGGSEAELAAFEKEIAAFESELQAYKGKGNPEVELLRDDAAFIRHFLQAYRHN

SEQ ID NO: 882 - protein, 73 aa, ARTIFICIAL SEQUENCE
  synthetic construct
MGSWVVFKVDLATIKYILEALGGSEAELAEFEGEIAGFEYSLQFYKGKGNPEVEALRKEAAAIRDELQAYRHN

SEQ ID NO: 883 - protein, 73 aa, ARTIFICIAL SEQUENCE
  synthetic construct
MGSWTIFKEWLAFIKTDLEALGGSEAELAFFEGWIASFEMELQKYKGKGNPEVEALRKEAAAIRDELQAYRHN

SEQ ID NO: 884 - protein, 73 aa, ARTIFICIAL SEQUENCE
  synthetic construct
MGSWEEFELRLNAIEERLYALGGSEAELAYFEYVIADFEGNLQRYKGKGNPEVEALYFEADAIFEELVAYRHN

SEQ ID NO: 885 - protein, 73 aa, ARTIFICIAL SEQUENCE
  synthetic construct
MGSWVVFKQRLAYIKDLLEALGGSEAELAYFEMSIAFFEEDLQVYKGKGNPEVEALRKEAAAIRDELQAYRHN

SEQ ID NO: 886 - protein, 73 aa, ARTIFICIAL SEQUENCE
  synthetic construct
MGSWVEFYERLDAIDRRLWALGGSEAELAAFEKEIAAFESELQAYKGKGNPEVEELRVHAASIRAWLQAYRHN

SEQ ID NO: 887 - protein, 73 aa, ARTIFICIAL SEQUENCE
  synthetic construct
MGSWFEFYDRLNAIDARLWALGGSEAELAAFEKEIAAFESELQAYKGKGNPEVESLRAHAAAIREWLQAYRHN

SEQ ID NO: 888 - protein, 73 aa, ARTIFICIAL SEQUENCE
  synthetic construct
MGSWSEFYDRLNAIDARLWALGGSEAELAAFEKEIAAFESELQAYKGKGNPEVESLRVHAAAIREWLQAYRHN

SEQ ID NO: 889 - protein, 73 aa, ARTIFICIAL SEQUENCE
  synthetic construct
MGSWSEFYDRLNAIDARLWALGGSEAELAAFEKEIAAFESELQAYKGKGNPEVESLRAHAAAIREWLQAYRHN

SEQ ID NO: 890 - protein, 73 aa, ARTIFICIAL SEQUENCE
  synthetic construct
MGSWSEFYDRLNAIDARLWALGGSEAELAAFEKEIAAFESELQAYKGKGNPEVESLKAHAAAIREWLQAYRHN

SEQ ID NO: 891 - protein, 73 aa, ARTIFICIAL SEQUENCE
  synthetic construct
MGSWSEFYDRLNAIDARLWALGGSEAELAAFEKEIAAFESELQAYKGKGNPEVESLQAHAAAIREWLQAYRHN

SEQ ID NO: 892 - protein, 73 aa, ARTIFICIAL SEQUENCE
  synthetic construct
MGSWSEFYDRLNAIDARLWALGGSEAELAAFEKEIAAFESELQAYKGKGNPEVESLRAHAAGIREWLQAYRHN

SEQ ID NO: 893 - protein, 73 aa, ARTIFICIAL SEQUENCE
  synthetic construct
MGSWFEFYDRLNAIDARLWALGGSEAELAAFEKEIAAFESELQAYKGKGNPEVESLREHAAHIREWLQAYRHN

SEQ ID NO: 894 - protein, 73 aa, ARTIFICIAL SEQUENCE
  synthetic construct
MGSWFEFYDRLNAIDARLWALGGSEAELAAFEKEIAAFESELQAYKGKGNPEVESLREHAAAIREWLQAYRHN

SEQ ID NO: 895 - protein, 73 aa, ARTIFICIAL SEQUENCE
  synthetic construct
MGSWSEFYDRLNAIDARLWALGGSEAELAAFEKEIAAFESELQAYKGKGNPEVESLREHAAAIREWLQAYRHN

SEQ ID NO: 896 - protein, 73 aa, ARTIFICIAL SEQUENCE
  synthetic construct
MGSWVEFEARLSAIYERLEALGGSEAELAAFEKEIAAFESELQAYKGKGNPEVEKLRRHAAGIRSNLQAYRHN

SEQ ID NO: 897 - protein, 73 aa, ARTIFICIAL SEQUENCE
  synthetic construct
MGSWVEFFVRLDAIWERLEALGGSEAELAAFEKEIAAFESELQAYKGKGNPEVETLRFHAAGIRQKLQAYRHN

SEQ ID NO: 898 - protein, 73 aa, ARTIFICIAL SEQUENCE
  synthetic construct
MGSWTEFNLRLDAIYERLEALGGSEAELAAFEKEIAAFESELQAYKGKGNPEVEALRWHAAGIRQQLQAYRHN

SEQ ID NO: 899 - protein, 73 aa, ARTIFICIAL SEQUENCE
  synthetic construct
MGSWMEFYDRLDAIWVRLEALGGSEAELAAFEKEIAAFESELQAYKGKGNPEVEVLRFHAAGIREQLQAYRHN

SEQ ID NO: 900 - protein, 73 aa, ARTIFICIAL SEQUENCE
  synthetic construct
MGSWHEFNGRLWAIYARLDALGGSEAELAAFEKEIAAFESELQAYKGKGNPEVETLRRHAAGIRGILQAYRHN

SEQ ID NO: 901 - protein, 73 aa, ARTIFICIAL SEQUENCE
  synthetic construct
MGSWYEFVQRLHAINDRLSALGGSEAELAAFEKEIAAFESELQAYKGKGNPEVEVLRRHAAGIRYTLQAYRHN

SEQ ID NO: 902 - protein, 73 aa, ARTIFICIAL SEQUENCE
  synthetic construct
MGSWAEFYQRLNAIWNRLEALGGSEAELAAFEKEIAAFESELQAYKGKGNPEVEVLRRHAAGIRGQLQAYRHN

SEQ ID NO: 903 - protein, 73 aa, ARTIFICIAL SEQUENCE
  synthetic construct
MGSWVEFNERLHAIYLRLDALGGSEAELAAFEKEIAAFESELQAYKGKGNPEVETLRRHAAGIRWQLQAYRHN

SEQ ID NO: 904 - protein, 73 aa, ARTIFICIAL SEQUENCE
  synthetic construct
MGSWNEFKLELAFIKDWLEALGGSEAELANFEEAIAEFEAGLQGYKGKGNPEVEALRKEAAAIRDELQAYRHN

SEQ ID NO: 905 - protein, 73 aa, ARTIFICIAL SEQUENCE
  synthetic construct
MGSWMEFEARLEAIWDRLEALGGSEAELAAFEKEIAAFESELQAYKGKGNPEVESLRFHAAGIRQHLQAYRHN

SEQ ID NO: 906 - protein, 73 aa, ARTIFICIAL SEQUENCE
  synthetic construct
MGSWVEFEDRLNAIWWRLEALGGSEAELAAFEKEIAAFESELQAYKGKGNPEVEKLRRHAAGIRTQLQAYRHN

SEQ ID NO: 907 - protein, 73 aa, ARTIFICIAL SEQUENCE
  synthetic construct
MGSWHHFKMHLAGIKLQLEALGGSEAELAEFEEWIADFEGALQDYKGKGNPEVEALRKEAAAIRDELQAYRHN

SEQ ID NO: 908 - protein, 73 aa, ARTIFICIAL SEQUENCE
  synthetic construct
MGSWAEFFARLDAIWERLEALGGSEAELAAFEKEIAAFESELQAYKGKGNPEVETLRFHAAGIRQKLQAYRHN

SEQ ID NO: 909 - protein, 73 aa, ARTIFICIAL SEQUENCE
  synthetic construct
MGSWAEFFARLDAIWDRLEALGGSEAELAAFEKEIAAFESELQAYKGKGNPEVETLRFHAAGIRQKLQAYRHN

SEQ ID NO: 910 - protein, 73 aa, ARTIFICIAL SEQUENCE
  synthetic construct
MGSWAEFFARLDAIWERLEALGGSEAELAAFEKEIAAFESELQAYKGKGNPEVETLKFHAAGIRQKLQAYRHN

SEQ ID NO: 911 - protein, 73 aa, ARTIFICIAL SEQUENCE
  synthetic construct
MGSWHEFRWRLFAIWQRLHALGGSEAELAAFEKEIAAFESELQAYKGKGNPEVEWLRLDAALIRVMLQAYRHN

SEQ ID NO: 912 - protein, 73 aa, ARTIFICIAL SEQUENCE
  synthetic construct
MGSWAEFRWRLHAIWLKLGELGGSEAELAAFEKEIAAFESELQAYKGKGNPEVEWLREDAEQIKYILQAYRHN

SEQ ID NO: 913 - protein, 73 aa, ARTIFICIAL SEQUENCE
  synthetic construct
MGSWAEFRWALHAIWLKLGELGGSEAELAAFEKEIAAFESELQAYKGKGNPEVEWLREDAEQIKYILQAYRHN

SEQ ID NO: 914 - protein, 73 aa, ARTIFICIAL SEQUENCE
  synthetic construct
MGSWAEFRWRLHAIWLKLGALGGSEAELAAFEKEIAAFESELQAYKGKGNPEVEWLRQDAAQIKYILQAYRHN

SEQ ID NO: 915 - protein, 73 aa, ARTIFICIAL SEQUENCE
  synthetic construct
MGSWAEFRWRLHAIWLQLGALGGSEAELAAFEKEIAAFESELQAYKGKGNPEVEWLRQDAAQIKYILQAYRHN

SEQ ID NO: 916 - protein, 73 aa, ARTIFICIAL SEQUENCE
  synthetic construct
MGSWAEFRWRLHAIWLRLGALGGTEAELAAFEKEIAAFESELQAYKGKGNPEVEWLRQDAAQIKYILQAYRHN

SEQ ID NO: 917 - protein, 73 aa, ARTIFICIAL SEQUENCE
  synthetic construct
MGSWAEFRWRLHAIWLRLGALGGSEAELAAFEKEIAAFESELQAYKGKGNPEVEWLRQDAAQIKYILQAYRHN

SEQ ID NO: 918 - protein, 73 aa, ARTIFICIAL SEQUENCE
  synthetic construct
MGSWAEFRWKLEAIWLRLGALGGSEAELAAFEKEIAAFESELQAYKGKGNPEVEWLRQDAAQIKYILQAYRHN

SEQ ID NO: 919 - protein, 73 aa, ARTIFICIAL SEQUENCE
  synthetic construct
MGSWAEFRWKLGAIWLRLGALGGSEAELAAFEKEIAAFESELQAYKGKGNPEVEWLRQDAAQIKYILQAYRHN

SEQ ID NO: 920 - protein, 73 aa, ARTIFICIAL SEQUENCE
  synthetic construct
MGSWYEFRWRLHAIWLRLGALGGSEAELAAFEKEIAAFESELQAYKGKGNPEVEWLRQDAAQIRYILQAYRHN

SEQ ID NO: 921 - protein, 73 aa, ARTIFICIAL SEQUENCE
  synthetic construct
MGSWHEFLRRLLAIEMRLYALGGSEAELAAFEKEIAAFESELQAYKGKGNPEVEHLRVRAASIRQMLQAYRHN

SEQ ID NO: 922 - protein, 73 aa, ARTIFICIAL SEQUENCE
  synthetic construct
MGSWWGFKVNLAWIKWKLEALGGSEAELAYFELWIANFEHSLQEYKGKGNPEVEALRKEAAAIRDELQAYRHN

SEQ ID NO: 923 - protein, 73 aa, ARTIFICIAL SEQUENCE
  synthetic construct
MGSWVNFKTHLARIKVHLEALGGSEAELALFEHDIANFEQVLQQYKGKGNPEVEALRKEAAAIRDELQAYRHN

SEQ ID NO: 924 - protein, 73 aa, ARTIFICIAL SEQUENCE
  synthetic construct
MGSWLVFKDELAGIKNYLEALGGSEAELATFEQDIAWFEQWLQNYKGKGNPEVEALRKEAAAIRDELQAYRHN

SEQ ID NO: 925 - protein, 73 aa, ARTIFICIAL SEQUENCE
  synthetic construct
MGSWKTFKIELAGIKLELEALGGSEAELAGFENAIAQFESSLQYYKGKGNPEVEALRKEAAAIRDELQAYRHN

SEQ ID NO: 926 - protein, 73 aa, ARTIFICIAL SEQUENCE
  synthetic construct
MGSWWEFKVRLSAIQYRLYALGGSEAELAAFEKEIAAFESELQAYKGKGNPEVEALREQAALIRTILQAYRHN

SEQ ID NO: 927 - protein, 73 aa, ARTIFICIAL SEQUENCE
  synthetic construct
MGSWWEFHIRLHAINYRLAALGGSEAELAAFEKEIAAFESELQAYKGKGNPEVEALRELAAKIRGDLQAYRHN

SEQ ID NO: 928 - protein, 73 aa, ARTIFICIAL SEQUENCE
  synthetic construct
MGSWWEFQVRLRAIQYRLNALGGSEAELAAFEKEIAAFESELQAYKGKGNPEVEYLRGLAAQIRFDLQAYRHN

SEQ ID NO: 929 - protein, 73 aa, ARTIFICIAL SEQUENCE
  synthetic construct
MGSWWEFKIRLYAIEYRLNALGGSEAELAAFEKEIAAFESELQAYKGKGNPEVEALRAKAAQIRYNLQAYRHN

SEQ ID NO: 930 - protein, 73 aa, ARTIFICIAL SEQUENCE
  synthetic construct
MGSWFEFNIRLHAIEYRLKALGGSEAELAAFEKEIAAFESELQAYKGKGNPEVEELRNYAASIRKLLQAYRHN

SEQ ID NO: 931 - protein, 73 aa, ARTIFICIAL SEQUENCE
  synthetic construct
MGSWFEFEIRLRAIEYRLSALGGSEAELAAFEKEIAAFESELQAYKGKGNPEVEKLRELAAEIRYALQAYRHN

SEQ ID NO: 932 - protein, 73 aa, ARTIFICIAL SEQUENCE
  synthetic construct
MGSWFEFKIRLYAIQYRLSALGGSEAELAAFEKEIAAFESELQAYKGKGNPEVEELRNLAAEIRHSLQAYRHN

SEQ ID NO: 933 - protein, 73 aa, ARTIFICIAL SEQUENCE
  synthetic construct
MGSWWEFKVRLRAIEYRLSALGGSEAELAAFEKEIAAFESELQAYKGKGNPEVEELRVLAASIRIHLQAYRHN

SEQ ID NO: 934 - protein, 73 aa, ARTIFICIAL SEQUENCE
  synthetic construct
MGSWSEFWFRLHAILYRLQALGGSEAELAAFEKEIAAFESELQAYKGKGNPEVETLRDAAAEIRVALQAYRHN

SEQ ID NO: 935 - protein, 73 aa, ARTIFICIAL SEQUENCE
  synthetic construct
MGSWIEFWVRLNAILYRLYALGGSEAELAAFEKEIAAFESELQAYKGKGNPEVEALRDSAAEIRRWLQAYRHN

SEQ ID NO: 936 - protein, 73 aa, ARTIFICIAL SEQUENCE
  synthetic construct
MGSWVEFWIRLNAIKYRLLALGGSEAELAAFEKEIAAFESELQAYKGKGNPEVEKLRQDAADIRELLQAYRHN

SEQ ID NO: 937 - protein, 73 aa, ARTIFICIAL SEQUENCE
  synthetic construct
MGSWTEFWWRLSAIVYRLNALGGSEAELAAFEKEIAAFESELQAYKGKGNPEVEELRDMAADIRSLLQAYRHN

SEQ ID NO: 938 - protein, 73 aa, ARTIFICIAL SEQUENCE
  synthetic construct
MGSWWEFYLRLRAISYRLQALGGSEAELAAFEKEIAAFESELQAYKGKGNPEVEGLRQDAAEIRKLLQAYRHN

SEQ ID NO: 939 - protein, 73 aa, ARTIFICIAL SEQUENCE
  synthetic construct
MGSWWEFHVRLRAIEYRLEALGGSEAELAAFEKEIAAFESELQAYKGKGNPEVEQLRLIAANIRHLLQAYRHN

SEQ ID NO: 940 - protein, 73 aa, ARTIFICIAL SEQUENCE
  synthetic construct
MGSWWEFHVRLKAIEYRLLALGGSEAELAAFEKEIAAFESELQAYKGKGNPEVEDLRYIAANIRQLLQAYRHN

SEQ ID NO: 941 - protein, 73 aa, ARTIFICIAL SEQUENCE
  synthetic construct
MGSWWEFKVRLKAIEYRLLALGGSEAELAAFEKEIAAFESELQAYKGKGNPEVEDLRYIAANIRQLLQAYRHN

SEQ ID NO: 942 - protein, 73 aa, ARTIFICIAL SEQUENCE
  synthetic construct
MGSWWEFQVRLAAIEYRLKALGGSEAELAAFEKEIAAFESELQAYKGKGNPEVENLRQLAAHIRSVLQAYRHN

SEQ ID NO: 943 - protein, 73 aa, ARTIFICIAL SEQUENCE
  synthetic construct
MGSWWEFQVRLSAIEYRLTALGGSEAELAAFEKEIAAFESELQAYKGKGNPEVEELRQKAARIRSLLQAYRHN

SEQ ID NO: 944 - protein, 73 aa, ARTIFICIAL SEQUENCE
  synthetic construct
MGSWWEFNIRLHAIDYRLKALGGSEAELAAFEKEIAAFESELQAYKGKGNPEVELLREKAAQIRAQLQAYRHN

SEQ ID NO: 945 - protein, 73 aa, ARTIFICIAL SEQUENCE
  synthetic construct
MGSWWEFRVRLEAIDYRLKALGGSEAELAAFEKEIAAFESELQAYKGKGNPEVEYLRMKAATIRAILQAYRHN

SEQ ID NO: 946 - protein, 73 aa, ARTIFICIAL SEQUENCE
  synthetic construct
MGSWYEFDIRLEAIKYRLSALGGSEAELAAFEKEIAAFESELQAYKGKGNPEVEYLRKKAAVIRSMLQAYRHN

SEQ ID NO: 947 - protein, 73 aa, ARTIFICIAL SEQUENCE
  synthetic construct
MGSWWEFRIRLEAIWYRLHALGGSEAELAAFEKEIAAFESELQAYKGKGNPEVEDLRIFAANIRSKLQAYRHN

SEQ ID NO: 948 - protein, 73 aa, ARTIFICIAL SEQUENCE
  synthetic construct
MGSWWEFNVRLQAIKYRLSALGGSEAELAAFEKEIAAFESELQAYKGKGNPEVEDLRKTAAHIRWQLQAYRHN

SEQ ID NO: 949 - protein, 73 aa, ARTIFICIAL SEQUENCE
  synthetic construct
MGSWWEFNVRLSAIRYRLLALGGSEAELAAFEKEIAAFESELQAYKGKGNPEVEDLRASAAQIRAMLQAYRHN

SEQ ID NO: 950 - protein, 73 aa, ARTIFICIAL SEQUENCE
  synthetic construct
MGSWWEFNMRLSAIKYRLYALGGSEAELAAFEKEIAAFESELQAYKGKGNPEVEILRRLAADIRERLQAYRHN

SEQ ID NO: 951 - protein, 170 aa, ARTIFICIAL SEQUENCE
  synthetic construct
DEMGSWDEFGRRLYAIEWRLYALGGSEAELAAFEKEIAAFESELQAYKGKGNPEVEKLREIAAVIRSNLQAYRHNGGGGSGGGGSGGGGSGMLQMAGQCSQNEYFDSLLHACIPCQLRCSSNTPPLTCQRYCNASVTNSVKGTNAGGGGSGGGGSGGGGSHHHHHHHHHH

SEQ ID NO: 952 - protein, 175 aa, ARTIFICIAL SEQUENCE
  synthetic construct
DEGGGGSMGSWAEFKQRLAAIKTRLQALGGSEAELAAFEKEIAAFESELQAYKGKGNPEVEALRKEAAAIRDELQAYRHNGGGGSGGGGSGGGGSGMLQMAGQCSQNEYFDSLLHACIPCQLRCSSNTPPLTCQRYCNASVTNSVKGTNAGGGGSGGGGSGGGGSHHHHHHHHHH

SEQ ID NO: 953 - protein, 343 aa, ARTIFICIAL SEQUENCE
  synthetic construct
DEHHHHHHHHHHKLENLYFQGGGGGSMGSWDEFGRRLYAIEWRLYALGGSEAELAAFEKEIAAFESELQAYKGKGNPEVEKLREIAAVIRSNLQAYRHNGGGGSGGGGSGGGGSLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 954 - protein, 343 aa, ARTIFICIAL SEQUENCE
  synthetic construct
DEHHHHHHHHHHKLENLYFQGGGGGSMGSWSEFWVRLGAIRERLDALGGSEAELAAFEKEIAAFESELQAYKGKGNPEVEKLRYTAATIRRFLQAYRHNGGGGSGGGGSGGGGSLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 955 - protein, 343 aa, ARTIFICIAL SEQUENCE
  synthetic construct
DEHHHHHHHHHHKLENLYFQGGGGGSMGSWAEFKQRLAAIKTRLEALGGSEAELAAFEKEIAAFESELQAYKGKGNPEVEALRKEAAAIRDELQAYRHNGGGGSGGGGSGGGGSLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 956 - protein, 438 aa, ARTIFICIAL SEQUENCE
  synthetic construct
DEGGGGSMGSWDEFGRRLYAIEWQLYALGGTEAELAAFEKEIAAFESELQAYKGKGNPEVEKLREIAAVIRENLQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSMGSWDEFGRRLYAIEWQLYALGGTEAELAAFEKEIAAFESELQAYKGKGNPEVEKLREIAAVIRENLQAYRHNGGGGSGGGGSGGGGSHHHHHHHHHH

SEQ ID NO: 957 - protein, 438 aa, ARTIFICIAL SEQUENCE
  synthetic construct
DEGGGGSMGSWSEFWVRLGAIRERLDALGGSEAELAAFEKEIAAFESELQAYKGKGNPEVEKLRYTAATIRRFLQAYRHNGGGGSGGGGSGGGGSGLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGVGGGGSGGGGSGGGGSMGSWSEFWVRLGAIRERLDALGGSEAELAAFEKEIAAFESELQAYKGKGNPEVEKLRYTAATIRRFLQAYRHNGGGGSGGGGSGGGGSHHHHHHHHHH

SEQ ID NO: 958 - protein, 338 aa, ARTIFICIAL SEQUENCE
  synthetic construct
MAFLWLLSCWALLGTTFGDYKDDDDKGGGGSGGGGSMGSWAEFKQRLAAIKTRLEALGGSEAELAAFEKEIAAFESELQAYKGKGNPEVEALRKEAAAIRDELQAYRHNGQAGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 959 - protein, 343 aa, ARTIFICIAL SEQUENCE
  synthetic construct
MAFLWLLSCWALLGTTFGDYKDDDDKGGGGSGGGGSMGSWDEFGRRLYAIEWRLYALGGSEAELAAFEKEIAAFESELQAYKGKGNPEVEKLREIAAVIRSNLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 960 - protein, 343 aa, ARTIFICIAL SEQUENCE
  synthetic construct
MAFLWLLSCWALLGTTFGDYKDDDDKGGGGSGGGGSMGSWSEFWVRLGAIRERLDALGGSEAELAAFEKEIAAFESELQAYKGKGNPEVEKLRYTAATIRRFLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 961 - protein, 343 aa, ARTIFICIAL SEQUENCE
  synthetic construct
MAFLWLLSCWALLGTTFGDYKDDDDKGGGGSGGGGSMGSWFEFYDRLNAIDARLWALGGSEAELAAFEKEIAAFESELQAYKGKGNPEVENLRVHAAAIREWLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 962 - protein, 343 aa, ARTIFICIAL SEQUENCE
  synthetic construct
MAFLWLLSCWALLGTTFGDYKDDDDKGGGGSGGGGSMGSWLEFYHRLNAIDSRLWALGGSEAELAAFEKEIAAFESELQAYKGKGNPEVESLRDHAAHIREWLQAYRHNGGGGSGGGGSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 963 - protein, 668 aa, ARTIFICIAL SEQUENCE
  synthetic construct
DSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRR

SEQ ID NO: 964 - protein, 22 aa, Homo sapiens
MAGSPTCLTLIYILWQLTGSAA

SEQ ID NO: 965 - protein, 204 aa, Homo sapiens
SGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSM

SEQ ID NO: 966 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 967 - protein, 630 aa, Homo sapiens
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLT

SEQ ID NO: 968 - protein, 229 aa, ARTIFICIAL SEQUENCE
  synthetic construct
LEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 969 - protein, 204 aa, ARTIFICIAL SEQUENCE
  synthetic construct
QESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 970 - protein, 204 aa, ARTIFICIAL SEQUENCE
  synthetic construct
QESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 971 - protein, 207 aa, ARTIFICIAL SEQUENCE
  synthetic construct
KYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 972 - protein, 207 aa, ARTIFICIAL SEQUENCE
  synthetic construct
KYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 973 - protein, 213 aa, ARTIFICIAL SEQUENCE
  synthetic construct
GEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 974 - protein, 213 aa, ARTIFICIAL SEQUENCE
  synthetic construct
GEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGPKLISKTRAALGV

SEQ ID NO: 975 - protein, 5 aa, ARTIFICIAL SEQUENCE
  synthetic construct
GGGGG

SEQ ID NO: 976 - protein, 8 aa, ARTIFICIAL SEQUENCE
  synthetic construct
GGGGGGGG

What is claimed is:

1. A protein comprising a D Domain (DD) target binding domain wherein the DD specifically binds BCMA and comprises the amino acid sequence of SEQ ID NO: 149, 152, 153, 154, 155, 156, 157, 158, 159, 160, 164, 165, 166, 167, 168, or 169.

2. The protein of claim 1, wherein the DD is fused to
   (a) antibody or antigen binding fragment thereof;
   (b) a transmembrane domain;
   (c) a membrane associating domain;
   (d) a serum protein or fragment thereof, or
   (e) an Fc domain.

3. A protein according to claim 1, which is conjugated to a therapeutic or cytotoxic agent.

4. The protein of claim 1, wherein the DD comprises the amino acid sequence of SEQ ID NO: 160.

5. The protein of claim 1, wherein the DD comprises the amino acid sequence of SEQ ID NO: 164.

6. The protein of claim 1, wherein the DD comprises the amino acid sequence of SEQ ID NO: 168.

7. A chimeric antigen receptor (CAR) which comprises a target binding domain comprising the protein of claim 1.

8. The CAR of claim 7, which further comprises a transmembrane domain and an intracellular signaling domain.

9. The CAR of claim 8, wherein the transmembrane domain comprises a CD8, 41BB or CD28 transmembrane domain.

10. The CAR of claim 8, wherein the intracellular signaling domain is selected from the group consisting of a domain of a human T cell receptor alpha, beta, or zeta chain; a human 41BB domain; a human CD28 domain; and any combination thereof.

11. The CAR of claim 8, wherein the intracellular signaling domain comprises the intracellular domain of a costimulatory molecule selected from the group consisting of CD27, CD28, 41BB, OX40, CD30, CD40, PD1, lymphocyte function-associated antigen-1 (LFA-1), CD2, CD7, LIGHT, NKG2C, NKG2D, B7-H3, a ligand that specifically binds with CD83, and any combination thereof.

12. The CAR of claim 8, wherein the DD comprises the amino acid sequence of SEQ ID NO: 160.

13. The CAR of claim 8, wherein the DD comprises the amino acid sequence of SEQ ID NO: 164.

14. The CAR of claim 8, wherein the DD comprises the amino acid sequence of SEQ ID NO: 168.

15. A cell engineered to express the CAR of claim 8.

16. A cell according of claim 15, wherein the cell is a T cell or a natural killer (NK) cell.

17. A pharmaceutical composition comprising the cell of claim 15.

18. The cell of claim 15, wherein the DD comprises the amino acid sequence of SEQ ID NO: 160.

19. The cell of claim 15, wherein the DD comprises the amino acid sequence of SEQ ID NO: 164.

20. The cell of claim 15, wherein the DD comprises the amino acid sequence of SEQ ID NO: 168.

21. An isolated nucleic acid encoding
    (a) the protein of claim 1; or
    (b) a chimeric antigen receptor (CAR) comprising a target binding domain comprising the protein of claim 1.

22. A vector comprising the nucleic acid of claim 21.

23. The vector of claim 22, which is a lentiviral vector.

24. A cell comprising the nucleic acid of claim 21.

25. A method of treating a subject suffering from a B cell mediated disease or disorder, the method comprising administering to the subject an effective amount of the cell according to claim 15.

26. The method of claim 25, wherein the B cell mediated disease or disorder is a B cell malignancy.

27. The method of claim 26, wherein the B cell malignancy is selected from the group consisting of: chronic lymphocytic leukaemia, follicular lymphoma, mantle cell lymphoma, and diffuse large B-cell lymphoma, plasmacytoma and multiple myeloma.

28. The method of claim 27, wherein the DD comprises the amino acid sequence of SEQ ID NO: 160.

29. The method of claim 27, wherein the DD comprises the amino acid sequence of SEQ ID NO 164.

30. The method of claim 27, wherein the DD comprises the amino acid sequence of SEQ ID NO 168.

31. The method of claim 26, wherein the B cell malignancy is multiple myeloma.

32. The method of claim 31, wherein the DD comprises the amino acid sequence of SEQ ID NO: 160.

33. The method of claim 31, wherein the DD comprises the amino acid sequence of SEQ ID NO: 164.

34. The method of claim 31, wherein the DD comprises the amino acid sequence of SEQ ID NO: 168.

35. The method of claim 25, wherein the DD comprises the amino acid sequence of SEQ ID NO: 160.

36. The method of claim 25, wherein the DD comprises the amino acid sequence of SEQ ID NO: 164.

37. The method of claim 25, wherein the DD comprises the amino acid sequence of SEQ ID NO: 168.

38. A method of treating a subject having cancer, the method comprising administering an immune cell comprising a chimeric antigen receptor (CAR) to the subject, wherein the CAR comprises:
   (a) a target binding domain comprising a D Domain (DD), wherein the DD specifically binds BCMA and comprises the amino acid sequence of SEQ ID NO: 149, 152, 153, 154, 155, 156, 157, 158, 159, 160, 164, 165, 166, 167, 168, or 169;
   (b) a CD8, 41BB or CD28 transmembrane domain; and
   (c) an intracellular domain comprising a signaling domain.

* * * * *